United States Patent 11,111,481 (ATTENUATED VIRUS MUTATED AT SITES OF EVOLUTIONARILY CONSERVED RNA STRUCTURE) - sequence listing, part 6

SEQ ID NO: 1583 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgtttatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgagagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgatgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtttcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggattttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttgatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccgctgaatgaaggggtgatggctgttgggcttgtgagcattctggccagttctctccttagaaatgacgtacccatggctggaccattagtagccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtattgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaacggtggctacgtcagcggaatagcgcaaacgaatgcagaaccagatggaccgacaccagaattggaagaagaaatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcttggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaacaatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttgggagtacccctgctggcattgggttgctattcacaagtgaacccactgactctaacagcggcagtactcttgctgatcacacattatgctattataggtccaggattgcaggcaaaagccactcgtgaagctcagaaaagaacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactctacgcacgaaatgtactggatatctaatggcacaggtaacattgtcgcttcagtcaacatggtatctagactgctactgaacaggttcacgatgacatacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgatgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaaaatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 1584 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaatcaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccaatacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagatcaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacattcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggggttctgaactcattaggcaaaatggtgcaccaaatattcggaagtgcttacacagccctattcagtggagtctcttgggtaatgaaaattggaataggagttctcttgacttggatagggttgaattcaaaaaacatatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatacaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttagggaaattagagctggacttcaactattgtgaaggaacaacagttgtcatcacagaaaactgtgggacaagaggcccatcattgcgaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgcactccttctctcagggcaaataacatggagagatatggcgcacacactaataatgattgggtccaacgcatctgacaggatgggaatgggcgtcacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaattttcacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttggaaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagaccacaacaggggaaataggagcaattgcactggatttcaagcctggaacctcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactacaacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggttattcaacttagtaggaagacttttgacacagaatatcagaaaactaaattgaatgattgggactttgtggtgacgactgacatttcagaaatgggggccaatttcaaagcagatagagtgatcgacccaagaagatgtctcaaaccagtcatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggattataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgctgcttataccagaaccagaaaagcagagaaccccccaagataaccaactcgcatatgtcgtgataggcatacttacattggcagcaacaatagcagccaacgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcactgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaagggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatccaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccagaacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccatcagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactggcatccaacgccatatgttcagcagtaccagtccactgggtccccacaagtagaacgacatggtctattcatgctcaccatcagtggatgacaacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1585 - DNA, 10173 bp, Dengue virus
atgaacaaccaacggaagaagacggggaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaaccttacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggaactacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccattttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggaattccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtggagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggtagaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaagcttgtggacagagaacgtgaactccacaaactgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcggcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1586 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtaacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtgggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctactcagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcatacaggagaccaacaccaagtgggaaatgacacgcagggagtcacggttgagataacaccccaggcatcaaccgttgaagccgtcctgcctgagtatggaacccttgggctagaatgctcaccacggacaggcttggatttcaatgaaatgattttattgacaatgaaaaacaaagcctggatggtacataggcaatggttctttgacctacctctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgttgacaggagctacagagattcaaaactcaggaggtacaagcatttttgcggggcacttgaaatgcagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagctagttctctccttaggaatgatgtgcccatggctggaccactagtggccgggggcttgttgatagcgtgctacgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaggtgggggttggagtgcagaaagaaggagtcttccacaccatgtggcacgtcacaagaggggcagtattgacgcacaatgggaaaagactggaaccaaactgggccagtgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccaacaccggaattggaagaagaaatgttcaaaaagcgaaatttaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattacagactttgttggaaagacggtgtggtttgtacctagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctagaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggacctaggtgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaaccagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagttttgaagatggttgagccatggctaaaaaacaaccagttttgcattaaagtattaaacccttacatgccaactgtgattgagcacttagaaagattacaaagaaagtatggaggaatgcttgtgagaaacccactctcacgaaactccacgcatgaaatgtactggatatccaatggtactggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgagaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaatacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgcgtggtgaaaccgattgatgacaggttcgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagtcatttggtaa

SEQ ID NO: 1587 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctattccttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaagactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaatacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagataaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattgaacccttacatgccaactgtaattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggacttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagaggttaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1588 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaataaaaggaaaaagacatcgctctgcctcatgatgatgttaccagcaacacttgctttccatctgacttcacgcgatggagagccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacattaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcccatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcatgtttgtgctccttctctcagggcaaataacatggagagatatggcacagacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatgacaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgcttttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgattgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacccaggtggcttgatgcccgcacttattcagatcccttagcactcaaggaattcaaggattttgcagctggcagaaagtcaatcgcccttgatcttgtgacagaaataggaagagtgccttcacatttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcctgatatcaggtaaagggattggaaagacttcaataggactcatttgtgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcttgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagccgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacataggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagggttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgtgtctacaatatgatgggcaagagagagaagaaactaggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggatatcatatctagaaaagaccaaagaggcagtggacaggtggggacttatggtctgaacacattcaccaacatggaagcccagttggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttttgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1589 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaactggttatggcgttcatagctttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacctgacttcacgcgatggagaaccgcgcatgattgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctagacatagagcttcagaagaccgaggccacccaactggcgaccctaaggaagttatgcattgagggaaaaattaccaacataacaactgactcaaggtgtcctacccagggggaagcgattctacctgaggagcaggaccagaactacgtgtgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgatacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcgcatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaattggaactcaaggggatgagctatgcaatgtgcttgaatacctttgtgttgaagaaggaagtctccgaaacgcagcatgggacaatactcattaaggtcgagtacaaaggggaagatgcaccttgcaagattcctttctccacagaggatggacaagggaaagcccacaatggtagattgatcacagccaacccagtggtggccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaatacttccatgtcattttcatgcattgtgataggaattatcacactctatctgggagccgtggtacaagctgacatggggtgcgccataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgcacacccaatcatgcgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatggtcatcccaaagagtctagctggtcccatttcacaacacaaccacaggcctgggtaccacacccaaacggcaggaccttggcacttgggaaaattggagctggactttaactattgtgaaggaacaacagtagttatcacagaaaactgtgggacaagaggcccatcattgagaacaacaacagtgtcagggaagctgatacacgaatggtgttgccgctcgtgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttggctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacgtgttcaaacacaattttcacgctgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacaccaaaaaggaggagctggccactgaatgagggagtgatggctgttgggcttgtgagcattctagccagttctctccttaggaatgatgtgcccatggctggaccactagtggccgggggcttgttgatagcgtgctatgtcataactggcacgtcagcagacctcactgtagaaaaggcagcagatgtaacatgggaggaagaagctgagcaaacaggagtgtcccacaatttgatgatcacagttgatgatgatggaacaatgagaataaaggatgatgagactgagaacattctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagatggaccgacaccggaattggaagaagaagtgttcaaaaagcgaaatctaaccataatggatcttcatcctgggtcaggaaagacgcggaaataccttccagccatcgtcagagaagcaatcaagagacgtttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatctgataataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttggaaagacggtgtggtttgtacctagcatcaaagctggaaatgacatagcaaactgcctgcggaaaaatgggaaaaaggtcatccaacttagtagaaagacttttgatacagaatatcaaaagaccagactgaatgattgggacttcgtggtgacaacagacatttcagaaatgggagccaactttaaagcagatagagtgatcgacccaagaagatgtctcaagccagtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggagacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctgctcttgggactcatgatcttattaacaggtggagcaatgcttttcctgatatcaggtaaagggattggaaagacttcaataggactcatttgcgttattgtttccagtggcatgttatggatggctgatgtcccacttcaatggatcgcgtcggctataatcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtatccctggcagccatagccaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatttttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggtggcccaggacacgaagaaccagtacctatgtccacatacggatggaacctagtcaagctaatgagtggaaaggacgtgttttatcttccacctgagaagtgtgacaccctattgtgtgacattggagaatcttcaccaagtccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtaccggcaacatcgtctcttcagtcaacatggtatccagattactactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtaaactccacaaattgggcaagtgtggaagctgtgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctagaaaagaccaaagaggcagtggacaggtggggacctatggtctgaacacattcaccaacatggaagcccaattggtcagacagatggaaggagaaggcgtgttgtcgaaggcagacctcgagaaccctcatctgctagagaagaaaatcacacaatggttggaaaccaaaggagtggagagattaaaaagaatggccatcagcggagatgattgcgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgaccacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1590 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacctatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatctttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggatttttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagaccccgccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgaggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacatctagcccacagaacgagaaacgccctggacaacttggtgatgctgcatacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgcttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagtcacacattatgccattataggtccaggattgcaggccaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagatttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaatatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccattcgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggggccaggtaccttgagttcgaagcactcggatttttaaatgaagaccactggttctcgcgtgaaaactcttacagtggggtagaaggagaaggactgcacaagttgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagggaagaaaatcacacaatggttggaaaccaaaggagtggagagattaaaaagaatggccatcagcggggatgattgcgtggtgaaaccgatcgatgacaggtttgccaatgccttgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccccacaagcagaacgacatggtctattcacgctcaccatcagtggatgactacagaagacatgcttactgtctggaacagggtgtggatagaggacaatccatggatggaagacaaaactccagtcacaacttgggaagatgttccatacctaggaaagagagaagatcaatggtgcggatcactcattggtctcacttccagagcaacctgggcccagaacatactcacagcaatccaacaggtgagaagccttataggcgatgaagaatttctggactacatgccttcgatgaagagatttaggaaggaggaggagtcagagggagccatttggtaa

SEQ ID NO: 1591 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatactgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccacattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagaaacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaattaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggatttcaatgaaatgatcttgctaacaatgaagaacaaagcatggatggtacacagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattggaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgccagaggtgcaaggcgcatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgtgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactgtgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgttgccgctcgtgcacacttcctcccctgcgatacatgggagaagacggttgctggtatggcatggaaatcagacccatcagtgagaaagaagagaacatggtaaagtctttagtctcagcgggaagtggaaaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttgaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaacatcctaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagccattgttagagaggcaatcaagagacgtttaagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcgaaaaaacgggaaaaaggtcattcaacttagtaggaagacttttgacacagaatatcagaaaactaaactgaatgattgggacttcgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcctataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcctgggactcatgatcttgttgacaggtggagcaatgcttttcttaatatcaggtaaagggattggaaagacttcaataggactcatctgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggctgcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggttcgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggatacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtcttacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1592 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgtgataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccattagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccaatcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1593 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccaatcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1594 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagattcctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1595 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggagacaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaaaggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatctttgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggactttgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccggcaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctataggcatgcggtggaggaactaccagagacaatggaaacactcctactcttgggactcatgatcttgttgacaggtggagcaatgcttttcttaatatcaggtaaagggattggaaagacttcaataggactcatttgtgtgattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaagggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacatcgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggctgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcttccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagggaagaccaatggtgtggatcacttattggtctcacttccagagcaacctgggcccagaacatacccacagcaattcaacaggtgagaagccttataggcaatgaagagtttctggactacatgcctgcaatgaagagatttaggaaggaggaggagtcggagggagccatttggtaa

SEQ ID NO: 1596 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggtaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggagaatcaccaacataacaactgactcaagatgtcctacccaaggggaagcggttttgcctgaggagcaggaccagaactacgtgtgtaagcatacatacgtggacagaggctgggggaatggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcatactgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatggtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgttcgtgcacacttcctcccctgagatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgaccgttgcctggagaacagccaccctgattttggccggagtttcgcttttaccagtgtgccagtcttcgagcatgaggaaaacagactggcttccaatgacagtagcagctatgggagttccacctctaccactttttatttttagcttaaaagacacactcaaaaggagaagctggccactgaatgaaggggtgatggctgttgggcttgtgagcattctggccagttctctccttaaaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggacttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctagctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcgaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagaccccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtccaaggagccaggtgttgtttctccaaccagctatttagatgtggacttgcacccagcatcagcctggacattgtacgctgtggccactacagtaataacaccaatgttaagacacaccatagagaattctacagcaaatgtgtccctggcagctatagccaaccaggcagtggtcctgatgggtttggacaaaggatggccaatatcgaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagccgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgagaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaattaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaaccccatttggccagcagagagtctttaaagagaaagtggacaccaggacacccaggtccatgccaggaacaagaagggttatggggatcacagcggagtggctctggagaaccttgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaatcacacaatggttggaaaccaaaggagtggagaggttaaaaagaatggccattagcggggatgactgcgtggtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactgataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacgtggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcagcaggtgagaagccttataggcaatgaagagtttctggactacatgccttcaatgaagagatttaggaaggaggaggagtcggagggagccatttggtaa

SEQ ID NO: 1597 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatttcaaacatgctgagcataatcaacaaacggaaaaagacatcgctctgtctcatgatgacattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaagcatcaactactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaagagcttcttgtgacatttaaaaacgcacatgcgaaaaaacaagaagtagttgtccttggatcgcaagagggagcaatgcacactgcattgacaggagccacagaaatccaaaactcaggaggtacaagcatttttgcggggcacttaaaatgtagacttaagatggacaaattagaactcaaggggatgagctatgcaatgtgcacgaatacctttgtgttgaaaaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctaggggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtggcagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaacttgggaagaaacacatgattgcgggggttttcttcacgtttgtactccttctctcagggcaaataacatggagagacatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggctcgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgaacgcacaatggcaaaagggggaggaggtgcaggttattgccgtagagcccgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcatccaacttagcaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaataccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgttattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatatagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcactcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaagtccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcctatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttctggaaacttgtggacagagaacgtgaactccacagattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaattaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagatcaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1598 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctacttttcaagacagcctctggaattaacatgtgcacactcatagccatggacttgggagaaatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacgtgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgtcttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatactgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagctggaagctagaaaaagcatccctcatagaggtgaaaacctgcacatggccaaaatcacataccctttggagtaatggtgtgttagagagtgacatgatcattccaaagagtctagctggccctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccctaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtaccaatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttgacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcataccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtatatatcaacccgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgcaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcacagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgctgtggatggccgaaatcccactccaatggatcgcgtcggccatagtcctggagtttttcatgatggtgttgcttataccagaaccagaaaagcagagaaccccccaagacaaccaactcgcatatgtcgtgataggcatacttacattggcagcaataatagcagctaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgcttctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagtcggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggctatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgcctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1599 - DNA, 10173 bp, Dengue virus; identical to SEQ ID NO: 1568

SEQ ID NO: 1600 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctacttttcaagacagcctctggaattaacatgtgcacactcatagccatggacttgggagaaatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacgtgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcacacatacgtagacagaggctgggggaacggatgtggtttgtttggcaagggaagcttggtaacatgtgcgaaatttcaatgcctggaaccaatagagggaaaagtggtgcaatatgagaacctcaagtacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggttgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttttgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagcggaatcttcgtcaccaacgaggtccatacctggacagagcaatacaaattccaagcagactccccaaaaagattggcgacagctattgcaggcgcttgggagaatggagtgtgcggaattaggtcaacaaccagaatggagaatctcctgtggaagcaaatagccaatgaactgaactacatactgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagctggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaatatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccctaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtaccaatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttgacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcataccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctggatcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaacccgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgactttgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcacagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgcttctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagagagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcacaattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggctatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaagggagtggagaggttaaaaagaatggccattagcggggatgattgcgtagtgaaaccaatcgatgacaggttcgctaatgccctgctcgctctgaacgatatgggaaaggttcggaaagacatacctcaatggcagccgtcaaagggatggcatgactggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgcctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1601 - DNA, 10173 bp, Dengue virus
atgaacaaccaacggaagaagacggggaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgataagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggaactacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagcccacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcactaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaaatgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgcttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacccagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaattgggctagcgtgaaaaaagatctgatttcatacggaggaggatggagattgagcgcacaatggcaaaagggggaggaggtgcaggttattgccgtggagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtttgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaggaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccacccgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttctctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggtagaaccatggctaaagaacaaccaattttgtattaaagtattgaacccttacatgccagctgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaagcttgtggacagagaacgtgaactccacaaactgggcaagtgtggaagctgtgtttacaacatgatgggcaagagagagaagaaacttggagagtttggcaaagcaaaaggcagtagagccatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1602 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatatcaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacaccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaagatcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcggggattttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaaacaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaagactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaatccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacatgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1603 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacatgcaatcaagccggagagcatagacgcgacaagagatcagtggcgttagctccccatgtcggcatgggactggacacacgtacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaaaatggacaaattagaactcaaggggatgagctatgcaatgtgcacgaatacctttgtgttgaagaaagaagtctcagaaacgcagcatgggacaatactcatcaaggtcgagtacaaaggggaagatgcaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatttccttaacgtgttcaaatacaatttttacgttgactgttgcctggagaacagccaccctgattttggccggagtttcgcttttaccagtgtgccagtcttcgagcatgaggaaaacagactggattccaatgacagtggcagctatgggagttccacctctaccactttttatttttagcttaaaagacacactcaaaaggagaagttggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttatcgccgtagagcctgggaagaacccaaagaactttcaaaccatgccaggcacttttcagactacaacaggggaaataggagcaattgcactggatttcaagcctggaacttcaggatctcctatcataaacagagagggaaagatagtgggactgtatggcaatggagtggttacaaagaatggtggctacgtcagcggaatagcgcaaacgaatgcagaaccagatggaccgacaccagaattggaagaagagatgttcaaaaaacgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacatcagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcttgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgttgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtatgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtgggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccggtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1604 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggtcttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacacagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacattttgcgggaaaacaatatcaaattaacggtagttgtgggcgatgtaattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaggattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaacggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgcttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggtaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctatagttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccccggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaacttatgaggaggggtgaccttccagtctggttagcccataaagtagcatcagaagggatcaaatatacagatagaaaatggtgctttgatggacaacgtaataatcaaattttggaagagaacatggatgtggaaatctggacaaaggaaggagaaaagaaaaaattgagacctaggtggcttgatgcccgcacctattcagatcccttagcactcaaggaattcaaagactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcgggctgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggttcttatgaagtcaaagccacaggctcagcctcctccatgataaatggagtcgtgaaactcctcaccaaaccatgggatgtggtgcccatggtgacacagatggcaatgacagatacaactccatttggccagcagagagtatttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtag

SEQ ID NO: 1605 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggcggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgcagacttaagatggacaaattagaactcaaggggatgagctatgcaatgtgcacgaataccttcgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcctgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagaccaatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacaacaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggacgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagcccatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaagtcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaagcatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctacatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagtccaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaacggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcagcaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1606 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggaaatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacatcgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctttaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccttattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatgtaattggggtcttagagcaaggaaaaagaacactaacactacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacacaccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaattgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccacttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcatccaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgctcataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgagaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacaggaaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtgcctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtggttgagcacctagaaagactacaaaggaaacatggaggaatgcttgtgagaaatccactttcacgaaactccacgcacgaaatgtactggatatctaatggcacaggcaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcaccaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcgtctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcactcattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1607 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaacctttaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactgatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggcttatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccataatcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtctctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcgaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactttagctacaggaccaataacaacactctgggaaggatcacctgggaagttttggaacaccacgatagctgtttccatggcgaacatttttagagggagctatttagcaggagctgggcttgccttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggacgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagtggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1608 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaacctttaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcctggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagccacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgttatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggcttatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcgaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgtagttcaacttttgttaatgagaacatcatgggccttgtgtgaagctttaactttagctacaggaccaataacaacactctgggaaggatcacctgggaagttttggaacaccacgatagctgtttccatggcgaacatttttagagggagctatttagcaggagctgggcttgccttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggacgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttttcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1609 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtaggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcacactgcattgacaggagccacagaaatccaaaactcaggaggtacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtgatgaaaattggaataggagttctcttgacttggatagggttgaattcaaaaaacacatccatgtcattttcatgcattgcgataggaatcatcacactctatctgggagctgtggtgcaagctgacatggggtgtgttataaactggaaaggcaaagaactcaaatgtggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaactcaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgaacgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaataccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactaactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatatagcaggagctgggcttgctttttctattatgaaatcagttggaacaggaaaaagaggaacaggctcacagggtgaaactttaggagaaaaatggaaaaagaagttaaatcaattatctcggaaagagtttgacctttacaagaaatctggaatcactgaagtggatagaacagaggccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1610 - DNA, 10173 bp, Dengue virus
atgaacaaccaacggaagaagacggggaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaaccttacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcattatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggaacctgtcaatattgaggctgaacctccttttggggaaagtaatatagtaattggaattggagacaacgccttgaaaatcaactggtacaagaagggaagctctattgggaagatgttcgaggccactgctagaggtgcaaggcgtatggccatcttgggagacacagcttgggactttggatcagtgggtggtgttctgaactcattaggcaaaatggtgcatcaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgtcataaactggaaaggcaaagaactcaaatgtggaagtggaattttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaaggaaaaagaacactaacaccacaacccatggagctaaaatactcatggaaaacgtggggaaaggcaaaaatagtgacagctgaaacacaaaattcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttgggaagaaacacatgattgcgggggttttcttcacgtttgtactccttctctcagggcaaataacatggagagatatggcgcacacactaataatgattgggtccaacgcatctgacaggatgggaatgggcgttacctacctagctttaatcgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttaacttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcattactaatagtatcaggaatctttccatactccatacccgcaacattgttggtctggcatacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggtcattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccagctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacctgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggcaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggtaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgcctacacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaaccagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggcttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccaataacaacactctgggaaggatcacctgggaagttttggaacaccacgatagctgtttccatggcgaacatttttagagggagctatttagcaggagctgggcttgctttttctattatgaaatcagttggaacggggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgtcattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtgacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttgggagccaggtaccttgagttcgaagcccttggattcttaaatgaagaccactggttctcgcgtgagaactcttacagtggagtggaaggagaaggactgcacaagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagaccttgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggtcccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagccttataggcaatgaagagtttctggactacatgccttcaatgaagagatttaggaaggaggaggagtcggagggagccatttggtaa

SEQ ID NO: 1611 - DNA, 10173 bp, Dengue virus
atgaacaaccaacggaagaagacgggaaaaccgtctatcaatatgctgaaacgcgtgagaaaccgtgtgtcaactggatcacagttggcgaagagattctcaaaaggactgctgaacggccagggaccaatgaaattggttatggcgttcatagctttcctcagatttctagccattccaccaacagcaggagtcttggctagatggggaaccttcaagaagtcgggggccattaaggtcctgaaaggcttcaagaaggagatctcaaacatgctgagcataatcaacaaacggaaaaagacatcgctctgtctcatgatgatattgccagcagcacttgctttccacttgacttcacgagatggagagccgcgcatgattgtggggaagaatgaaagaggaaaatccctactttttaagacagcctctggaattaacatgtgcacactcatagccatggacttgggagagatgtgtgatgacacggtcacttacaaatgcccccatattaccgaagtggaacctgaagacattgactgctggtgcaacctcacatcaacatgggtgacttatggaacgtgcaatcaagccggagagcatagacgcgacaagagatcagtggcgttagctccccatgtcggcatgggactggacacacgcacccaaacctggatgtcggctgaaggagcttggaggcaagtcgagaaggtagagacatgggcccttaggcacccagggttcaccatactagccctatttcttgcccattacataggcacttccttgacccagaaggtggttatttttatactactaatgctggtcaccccatccatgacaatgagatgtgtgggagtaggaaacagagattttgtggaaggtctatcaggagctacgtgggttgacgtggtgctcgagcacggggggtgtgtgaccaccatggctaagaacaagcccacgttggatatagagcttcagaagaccgaggccacccaactggcgaccctaaggaagctatgcattgaggggaaaatcaccaacataacaactgactcaagatgtcctacccaaggggaagcggttttgcctgaggagcaggaccagaactacgtgtgtaagcatacatacgtagacagaggctgggggaacggatgtggtttgtttggcaagggaagcttggtaacatgtgcgaaatttcaatgcctggaaccaatagagggaaaagtggtgcaatatgagaacctcaaatacaccgtcatcatcacagtgcacacaggagaccaacaccaggtgggaaatgaaacgcagggagtcacggctgagataacacctcaggcatcaaccactgaagccatcttgcctgaatatggaacccttgggctagaatgctcaccacggacaggtttggacttcaatgaaatgatcttgctaacaatgaagaacaaagcatggatggtacatagacaatggttttttgacctacctctaccatggacatcaggagctacaacggaaacaccaacctggaacaggaaggagcttcttgtgacatttaaaaacgcacatgcgaaaaaacaagaagtagttgtccttggatcgcaagagggagcaatgcataccgcattgacaggagccacagaaatccaaaactcaggaggcacaagcatttttgcggggcacttaaaatgtagacttaagatggacaaattagaactcaaggggatgagctatgcaatgtgcacgaatacctttgtgttgaagaaagaagtctcagaaacgcagcatgggacaatactcatcaaggtcgagtacaaaggggaagatgtaccttgcaagattcctttctccacagaggatggacaagggaaagctcacaatggcagactgattacagccaacccagtggtgactaagaaggaggagcctgtcaatattgaggctgaacctccttttggggaaagtaatatagtaattggaattggagacaacgccttgaaaatcaactggtacaagaagggaagctctattgggaagatgttcgaggccactgctagaggtgcaaggcgcatggccatcttgggagacacagcttgggactttggatcagtgggtggtgttctgaactcattaggcaaaatggtgcaccaaatattcggaagtgcttacacagccctattcagtggagtctcttgggtaatgaaaattggaataggagttctcttgacttggatagggttgaattcaaaaaacacatccatgtcattttcatgcattgcgataggaatcattacactctatctgggagctgtggtgcaagctgacatggggtgtgttataaactggaaaggcaaagaactcaaatgcggaagtggaatcttcgtcaccaacgaggtccatacctggacagagcaatacaaattccaagcagactccccaaaaagattggcgacagccattgcaggcgcttgggagaatggagtgtgcggaattaggtcaacaaccagaatggagaatctcctgtggaagcaaatagccaatgaactgaactacatattgtgggaaaacaatatcaaattaacggtagttgtgggcgatataattggggtcttagagcaagggaaaagaacactaacaccacaacccatggagctaaaatactcatggaaaacgtggggaaaggcaaaaatagtgacagctgaaacacaaaactcttctttcataatagatggaccaaacacaccggagtgtccaagtgcctcaagagcatggaatgtgtgggaggtggaagattacgggttcggagtcttcacaaccaacatatggctgaaactccgagaggtgtatacccaactatgtgaccataggctaatgtcggcagccgtcaaggatgagagggccgtacatgccgacatgggctattggatagaaagccaaaagaatggaagttggaagctagaaaaagcatccctcatagaggtgaaaacctgcacatggccaaaatcacataccctttggagtaatggtgtgttagagagtgacatgatcattccaaagagtctagctggtcctatctcgcaacacaactacaggcccgggtaccacacccagacggcgggaccctggcatttaggaaaattagagctggacttcaactattgtgaaggaacaacagttgtcatcacagaaaactgtgggacaagaggcccatcattgagaacaacaacagtgtcagggaagttaatacacgaatggtgctgccgctcgtgcacacttcctcccctgcgatacatgggagaagacggttgctggtatggcatggaaatcagacccatcagtgagaaagaagagaacatggtaaagtctttagtctcagcgggaagtggagaggtggacaacttcacaatgggtgtcttgtgtttggcaatcctctttgaagaggtgatgagaggaaaatttggaaagaaacacatgattgcgggggttttcttcacgtttgtactccttctctcagggcaaataacatggagagatatggcgcacacactaataatgattgggtccaacgcatctgacaggatgggaatgggcgttacctacctagctttaattgcaacatttaaaatccagccattcttggctttgggatttttcctaagaaaactgacatccagagaaaatttattgttaggagttgggctggctatggcaacaacgttacaactgccagaggacattgaacaaatggcaaatggaatcgctctggggctcatggctcttaaactgataacacaatttgaaacataccaattatggacagcattaatctccttaacgtgttcaaatacaatttttacgttgactgttgcctggagaacagccaccctgattttggccggagtttcgcttttaccagtgtgccagtcttcgagcatgaggaaaacagactggcttccaatgacagtggcagctatgggagttccacctctaccactttttatttttagcttaaaagacacactcaaaaggagaagctggccactgaatgaaggggtgatggctgttgggcttgtgagcattctggccagttctctccttagaaatgatgtacccatggctggaccattagtggccgggggcttgctgatagcgtgctacgtcataactggcacgtcagcagacctcaccgtagaaaaagcagcagatgtaacatgggaggaagaggctgagcaaacaggagtgtcccacaacttaatgatcacagttgatgatgatggaacaatgagaataaaagatgatgagactgagaatatcttaacagtgcttttgaaaacagcactactaatagtatcaggaatctttccatactccatacccgcaacattgttggtctggcacacttggcaaaagcaaacccaaagatccggcgttctatgggatgtacctagccctccagagacacagaaagcagaactggaagaaggggtctataggatcaaacagcaaggaatttttgggaaaacccaagtaggggttggagtacagaaagaaggagtctttcacaccatgtggcacgttacaagaggggcagtgttgacatataatgggaaaagactggaaccaaactgggctagcgtgaaaaaagatctgatttcatacggaggaggatggagattgagcgcacaatggcaaaagggggaggaggtgcaggttattgccgtagagcctgggaagaacccaaagaactttcaaaccatgccaggcacttttcagactacaacaggggaaataggagcaattgcactggatttcaagcctggaacttcaggatctcctatcataaacagagagggaaaggtagtgggactgtatggcaatggagtggttacaaagaatggtggctacgtcagcggaatagcgcaaacgaatgcagaaccagatggaccgacaccagaattggaagaagagatgttcaaaaagcgaaatctaaccataatggatcttcatcctgggtcaggaaagacacggaaataccttccggctattgttagagaggcaatcaagagacgtttgagaactctaattctggcaccgacaagggtggttgcagctgagatggaagaagcattgaaagggctcccaataaggtaccaaacaacagcaacaaaatctgaacacacaggaagagagattgttgatctgatgtgccacgcaacgttcacaatgcgtctgctgtcaccagttagggttccaaactataacttgataataatggatgaagcccatttcacagacccagccagtatagctgctagagggtacatatcaactcgtgttggaatgggagaagcagccgcaattttcatgacagcaacgccccctggaacagctgatgcctttcctcagagcaacgctccaattcaagatgaagaaagggacataccagaacgctcatggaattcaggtaatgaatggataaccgacttcgctgggaaaacggtgtggtttgtccccagcattaaagccggaaatgacatagcaaactgcctgcggaaaaacgggaaaaaggtcattcaacttagtaggaagacttttgacacagaatatcagaaaactaaactgaatgattgggactttgtggtgacgactgacatttcagaaatgggggccaatttcaaagcagatagagtgatcgacccaagaagatgtctcaaaccagtgatcctgacagatggaccagagcgggtgatcctggctggaccaatgccagtcaccgcggcgagtgctgcgcaaaggagagggagagttggcaggaacccacaaaaagaaaatgaccagtacatattcacgggccagcctctcaacaatgatgaagaccatgctcactggacagaagcaaaaatgctgctggacaacattaacacaccagaagggatcataccagctctctttgagccagaaagggagaagtcagccgccatagacggtgagtatcgcctgaaaggtgagtccaggaagactttcgtggaactcatgaggaggggtgaccttccagtctggttagcccataaagtagcatcagaagggatcaaatatacagatagaaaatggtgctttgatggacaacgtaataatcaaattttagaagagaacatggatgtggaaatctggacaaaggaaggagaaaagaaaaaattgagacctaggtggcttgatgcccgcacctattcagatcccttagcactcaaggaattcaaggactttgcggctggcagaaagtcaatagcccttgatcttgtgacagaaataggaagagtgccttcacacctagctcatagaacgagaaacgctctggacaatctggtgatgctgcatacgtcagaacatggcggtaaggcctacaggcatgcggtggaggaactaccagagacaatggaaacactcctactcttgggactcatgatcttgttgacaggtggagcaatgcttttcttaatatcaggtaaagggattggaaagacttcaataggactcatttgtgtaattgcttccagcggcatgttgtggatggccgaaatcccactccaatggatcgcgtcggccatagtcctggagttttttatgatggtgttgcttataccagaaccagaaaagcagagaaccccccaagacaaccaactcgcatatgtcgtgataggcatacttacattggcagcaataatagcagccaatgaaatgggattgttggaaactacaaagagagatttaggaatgtctaaggagccaggtgttgtttctccaatcagctatttagatgtggacttgcacccagcatcagcctggacattgtacgctgtggccactacagtaataacaccaatgttaagacataccatagagaattctacagcaaatgtgtccctggcagctatagccaaccaggcagtggtcctgatgggtttggacaaaggatggccaatatcaaaaatggacttaggagtacccctgctggcattgggttgctattcacaagtgaacccactgactctaacagcggcagtactcttgctgatcacacattatgctattataggtccaggattgcaggcaaaagccactcgtgaagctcagaaaaggacagctgctggaataatgaagaatccaacggtggatgggataatgacaatagacctagatcctgtaatatatgattcaaaatttgaaaagcaactgggacaggttatgctcctggttttgtgtgcagttcaacttttgttaatgagaacatcatgggccttgtgtgaagctttaactctagctacaggaccgataacaacactctgggaaggatcacctgggaagttttggaacaccacgatagctgtttccatggcgaacatttttagagggagctatttagcaggagctgggcttgctttttctattatgaaatcagttggaacagggaaaagaggaacaggctcacagggtgaaactttaggagaaaaatggaaaaagaagttaaatcaattatcccggaaagagtttgacctttacaagaaatctggaatcactgaagtggatagaacagaagccaaagaagggttgaaaagaggagaaataacacatcatgccgtgtccagaggtagcgcaaaacttcaatggtttgtggagagaaacatggtcattcccgaaggaagagttatagacttgggctgtggaagaggaggctggtcatattactgtgcaggactgaaaaaagtcacagaagtgcgaggatacacaaaaggcggtccaggacacgaagaaccagtacctatgtccacatatggatggaacatagtcaagttaatgagtggaaaggatgtgttttatcttccacctgaaaagtgtgacaccctgttgtgtgacattggagaatcttcaccaagcccaacagtggaagaaagcagaactataagagttttgaagatggttgaaccatggctaaagaacaaccaattttgtattaaagtattgaacccttacatgccaactgtgattgagcacctagaaagactacaaaggaaacatggaggaatgcttgtgagaaatccactttcacgaaactccacgcacgaaatgtactggatatctaatggcacaggtaacattgtcgcttcagtcaacatggtatctagactgctactgaacaggttcacgatgacacacagaagacccaccattgagaaagatgtggatttaggagcaggaactcgacatgttaatgcggaaccagaaacacccaacatggatgttattggggaaagaataaaaaggatcaaggaggagcataattcaacatggcactatgatgacgaaaacccctacaaaacgtgggcttaccatggatcttatgaagtcaaagccacaggctcagcctcctccatgataaatggagtcgtgaaactcctcactaaaccatgggatgtggtgcccatggtcacacagatggcaatgacagatacaactccatttggccagcagagagtctttaaagagaaagtggacaccaggacacccaggtccatgccaggaacaagaagggttatggggatcacagcggagtggctctggagaaccctgggaaggaacaaaaaacccaggttatgcacaagggaagagtttacaaaaaaggtcagaactaacgcagccatgggagccgttttcacagaggagaaccaatgggacagcgcgaaagctgctgttgaggatgaggatttttggaaacttgtggacagagaacgtgaactccacaaattgggcaagtgtggaagctgtgtttacaacatgatgggcaagagagagaagaaacttggagagtttggcaaagcaaaaggcagtagagctatatggtacatgtggttaggagccaggtaccttgagttcgaagcccttggattcttaaatgaagaccactggttctcgcgtgagaactcttacagtggagtggaaggagaaggactgcataagctaggctatatattaagggacatttccaagatacccggaggagctatgtatgctgatgacacagctggttgggacacaagaataacagaagatgacctgcacaatgaggaaaagatcacacagcaaatggaccctgaacacaggcagttagcgaacgctatatttaagctcacataccaaaacaaagtggtcaaagttcaacgaccgactccaacaggcacggtaatggacatcatatctaggaaagaccaaagaggcagtggacaggtaggaacttatggtctgaatacattcaccaacatggaagcccagttaatcagacaaatggaaggagaaggtgtgctgtcaaaggcagacctcgagaaccctcatctgccagagaagaaaattacacaatggttggaaaccaaaggagtggagaggttaaaaagaatggccattagcggggatgattgcgtagtgaaaccaatcgatgacaggttcgctaatgccctgctcgctctgaacgatatgggaaaggttcggaaagacatacctcaatggcagccatcaaagggatggcatgattggcaacaggttcctttctgctcccaccactttcatgaattgatcatgaaagatggaagaaagttggtggttccctgcagaccccaggacgaactaataggaagagcaagaatctctcaaggagcgggatggagccttagagaaaccgcatgtctggggaaagcctacgctcaaatgtggagtctcatgtattttcacagaagagacctcagactagcatccaacgccatatgttcagcagtaccagtccactgggtccccacaagtagaacgacatggtctattcatgctcaccatcagtggatgaccacagaagacatgcttactgtctggaacagggtgtggatcgaggacaatccatggatggaagacaaaactccagtcacaacctgggaaaatgttccatatctagggaagagagaagaccaatggtgcggatcacttattggtctcacttccagagcaacctgggcccagaacatacccacagcaattcaacaggtgagaagcctcataggcaatgaagagtttctggactacatgccttcaatgaagagatttaggaaggaggaggagtcggagggagccatttggtaa

SEQ ID NO: 1612 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttttagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttcccagcaacacttgcttttcacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactggctctatttcttgcccattacataggcacttccctgacccagaaagtggttatctttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggatatagagcttcagaagaccgaggccacccaactggcgaccctaaggaagttatgcattgagggaaaaatcaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaggtgggaaatgatacgcagggagtcacggttgagataacaccccaggcttcaaccgttgaagctgtcttgcctgagtatggaacccttgggctagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagccacagagattcaaaactcaggaggtacaagcatttttgcggggcacctgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacagtggtagattgatcacagccaacccagtggtgaccaagaaggaggagcctgtcaacattgaggctgaacctccttttggggaaagcaacatagtgattggaattggagacaaagccttgaaaattaactggtacaagaaggggagctcgattgggaagatgttcgaggccactgccagaggtgcaagacgcatggccatcttgggagacacagcctgggactttggttcagtgggtggtgttctaaattcattagggaaaatggtgcaccaaatattcggaagtgcttacacagccctgtttagcggagtctcatgggtaatgaaaataggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccccaaaagactggccacagccatcgcaggcgcttgggaaaatggagtctgtggaatcaggtcaacaaccagaatggagaatctattgtggaagcaaatagccaatgagctgaactacatattatgggaaaacaacatcaaattaacggtggttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacactccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccgaaatcacacactctttggagcaatggtgtactagagagtgacatgatcatcccaaagagtctagctggtcctatttcacaacacaaccacaggcccggataccacacccaaacggcaggaccttggcacttgggaaaattggagctggactttaactattgtgaaggaacaacagtagtcattacagaaaactgtgggacaagaggcccatcattgagaacaacaacggtgtcagggaagctgatacacgaatggtgttgccgctcgtgcacacttcctcccttgcgatacatgggagaggatggctgttggtatggcatggaaattagacctatcaatgagaaagaagagaacatggtgaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttctaacacaattttcacgttgactgttgcctggagaacagccaccctgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagagaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttggaaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgaacgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaaccctaattttggcaccaacaagagtggttgcagctgagatggaagaagcactgaaaggactcccaataaggtatcaaacaactgcaacaaaatctgaacacacaggaagggagattgttgatttaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgaatgggacttcgtggtgacaacagacatttcagaaatgggagctaactttaaagcagatagagtgattgacccaagaagatgtctcaagccagtaatcttgacagatggacctgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacgcagacagaaaatggtgctttgatggagaacgtaataatcaaattttagaggagaacatggatgtggaaatctggacaaaagaaggagaaaggaaaaaactgagacctaggtggcttgacgcccgcacttattcagatcccttagcgctcaaggaattcaaggattttgcagctggcagaaagtcaatcgcccttgatcttgtgacagaaataggaagagtgccctcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacattggctgcgatagtagcagctaatgaaatgggattattggaaactacaaagagagatttaggaatgtctaaggaaccaggtgttgtttctccaaccagctatttagatgtagacttgcacccagcatcagcctggacattgtacgccgtggccacaacagtaataacaccaatgttgagacataccatagagaattctacggcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggactgcaggccaaagccactcgtgaagctcaaaaaagaacagctgctggaataatgaagaacccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttccatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttataaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtttttaaagagaaagtggacaccaggacacccaggcccatgccagggacaagaaaggtaatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggatcctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaagccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctatgctcaaatgtggagtctcatgtattttcacagaagagatcttagactagcatccaacgccatttgttcagcagtaccagtccattggatccctacaagcagaacgacatggtccattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1613 - DNA, 10173 bp, Dengue virus
atgaacaaccaacgaaaaaagacgggaaaaccgtctatcaatatgctgaaacgcgtgagaaaccgtgtgtcaactggatcgcagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggtttcaagaaggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcggcatgggtgacttacggaacgtgcaatcaagctggggagcatagacgtgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaggcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatatgagaacctcaaatacactgttatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaactggaactcaaggggatgagctatgcaatgtgcttgaatacctttgtgttgaggaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacttggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagccggtcccatttcacaacacaatcataggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcatgcacacttcctcccttgcgatacatgggagaggacggctgctggtatggcatggaaattagacctaccaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgtcgggcttgtgagcattctggctagttctctccttaggaatgatgtgcccatggctggaccattagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctatgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaactgcaacaaaatctgaacacacaggaagggagattgttgatttaatgtgccacgcaacattcacaatgcgcttgctatcaccagtcagggttccaaattacaatctgataataatggatgaggcccatttcacagatccagccagtatagcggctagagggtacatatcaacccgtgtaggaatgggagaggcagctgcaattttcatgacagcaacaccccctggaactgctgaagcctttccccagagcaacgctccaattcaagatgaagaaagggatattccggaacgctcgtggaactcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcctataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcggatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagactacaataggactcatttgtgttattgtttccagtggcatgttatggatggctgatatcccacttcaatggatcgcgtcggctatagtcctggaattttttatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgttagtcacacattatgccattataggtccaggattgcaggctaaagccactcgtgaagctcaaaaaagaacagctgctggaataatgaagaatccaacggtggatgggataatgacaatagacctagatcctgtgatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagtcacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtactggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtatttaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaacttcacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacctgcacaatgaggaaaaaatcacacagcaaatggaccctgaacacagacaattagcgaacgccatattcaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaacaaaggagtggagagattaaaaagaatggccatcagcggggatgattgcgtggtgaaaccgatcgatgacaggtttgctaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcttacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttgctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagaaggagccatttggtaa

SEQ ID NO: 1614 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggtcatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacctataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaagggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccacaggcccgggtaccacacccaaacgacaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagacatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattgctaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcaccctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagactagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagccctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggatgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttccaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1615 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaagggtagagacatgggctcttaggcacccaggtttcaccatactagctctatttcttgcccattacataggcacttccctgacccagaaagtggtcatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcccacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtacaccaaatattcggaagtgcttacacagccctgtttagcggagtctcatggataatgaaaattggaataggtgtcctcttaacctggataggattgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggcgtactagagagtgacatgatcatcccaaagagtctagctggtcctatttcacaacacaaccacaggcccgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagacatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattttggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtaatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacgtggcaaaagcaaacccaaagatctggcgttctatgggacgtacccagccccccagaaacacagaaagcagaactggaagagggggtctataggatcaaacaacaaggaatttttgggaaaacccaagtgggggtaggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcccatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcaccctgggtcaggaaagacgcggaaatatcttccagccatcgtcagagaagcaatcaagagacgcttaagaactctaattttggcaccaacaagagtggttgctgctgagatggaagaagcactgaaaggactcccaataaggtatcaaacaaccgcaacaaaatctgaacacacaggaagggagattgttgatctaatgtgccacgcaacattcacaatgcgcctactatcaccggtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttgatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggctagctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaagaaccagtacctatgtctacatacggatggaacatagtcaagttaatgagtggaaaggacgtgttttatctttcacctgaaaagtgtgacaccctattgtgtgacattggagaatcttcaccaagcccaacagtggaagaaagcagaactataagagttttgaagatggttgagccatggctaagaaacaaccagttttgcatcaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcagggactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacataccaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1616 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttacttttcaagacagcttctggaatcaacatgtgcactctcatagctatggacttgggagagatgtgtgatgacacggtcacttataagtgccccctcattgctgaagtggaaccagaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgcgtgaccaccatggctaagagcaagcctacgctggacatagagcttcaaaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatatgtggacagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaggtgggaaatgacacgcagggagtcacggttgagataacacctcaggcatcaaccgttgaagctgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaaacaagaagtggttgtccttggatcgcaagagggagcaatgcacacagcgctgacaggagctacagagattcaaaactcaggaggtacaagcatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccaccgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtatcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacctagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcattttccagacaacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagccccttaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccatagaacgagaaacgccctggacaacttggtgatgctgcacacgtcagaacatggcggtagggcctacagacatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagatcagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgcaggactgaaaaaagttacagaagtgcgaggatacacaaaaggcggcccaggacacgaggaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaactgtgattgagcacctagaaagactacaaagaaaacatggaggaatgcttgtgagaaacccactctcacgaaactccacgcatgaaatgtactggatatccaatggtaccggcaacatcgtctcttcagtcaatatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcttcctccatgataaatggagtcgtgaaactcctcacaaaaccatgggatgtggttcccatggtgacacagatggcaatgacagatacaactccatttgggcagcaaagagtcttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaatatgatgggcaagagagagaaaaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcatacaatggttggaaaccaaaggagtggagagattaaaaagaatggccatcagcggggatgattgcgtggtgaaaccgatcgatgacaggtttgccaatgccctgcttgccttgaacgacatgggaaaggtcaggaaggacataccccaatggcagccatcaaaggggtggcatgattggcaacaggtccctttctgctcccaccactttcatgaactgatcatgaaagatggaagaaagctggtggttccctgcagaccccaggacgaactaataggaagggcgagaatctctcaaggagcaggatggagccttaaagaaactgcatgcctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctttctgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1617 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggtcatggcgttcatagctttcctcagatttctagccattccaccaacagcaggagttttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcttctggaatcaacatgtgcactctcatagctatggacttgggagagatgtgtgatgacacggtcacttataaatgccccctcattgctgaagtggaacctgaagacattgactgctggtgcaacctcacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaattggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgaaaaccttaaatacactgtcatcatcacagtgcacacaggagaccaacaccaggtgggaaatgacacgcagggagtcacagttgagataacaccccaggcatcaaccgttgaagctgtcttgcctgagtatggaacccttggactagaatgctcaccacggacaggcctggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgctcatgcaaaaaagcaagaagtggttgtccttggatcgcaagagggagcaatgcacacagcgctgacaggagctacagagattcaaaactcaggaggtacaagcatttttgcggggcatttgaaatgtagactcaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgttcgaggccactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaaatggaatttttgtcactaatgaggtccacacttggacagagcaatacaaatttcaagcagactcccccaaaagactggcgacagccatcgcaggcgcttgggaaagtggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacctggccaaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaattcagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactaataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaggagctggccactgaatgagggagtgatggctgttgggcttgtgagcatcctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtttcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaggtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtggtgggactgtatggcaatggagtggttacaaaaaatggtggctacgtcagtggaatagcgcaaacaaatgcagaaccagacggaccgacaccggaattggaagaagaaatgttcaaaaagcgaaatctaactataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttggtaataatggatgaggcccatttcacagacccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcatggaattcaggcaatgaatggattaccgacttcgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacttattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcttacaggcatgcagtagaggaactaccagaaacaatggaaacactcctactcttgggactcatgatcttattaacaggtggagcaatgcttttcttgatatcaggtaaagggattggaaagacttcaataggacttatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggctgcgatagtagcagctaatgaaatgggattattggaaaccacaaagagagatttaggaatgtctaaagaaccaggtgttgtttctccaaccagctatttagatgtagatttgcacccagcatcagcctggacattgtacgccgtggccacaacaataataacaccaatgttgagacataccatagagaattccacagcaaatgtttccctggcagccatagctaaccaggcagtggtcctgatgggtttagacaaaggatggccaatatcgaaaatggacctaggcgtaccgctattggcactgggctgctattcacaagtgaacccactgactctcacagcggcagtacttctgctagttacacattatgccattataggtccaggattgcaggctaaagccactcgtgaagcccaaaaaagaacagctgctggaataatgaagaatccaacggtggacgggataatgacaatagacctagatcctgtaatatacgattcaaaattcgaaaagcaactaggacaggtcatgctcttggttctgtgtgcagttcaacttttgttaatgaggacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaggaagggttgaaaagaggagaaacaacacatcatgctgtgtccagaggcagcgcaaaacttcaatggttcgtggagaggaacatggtcattcccgaaggaagagtcatagacctaggctgtggaagaggaggctggtcatattattgcgcgggactgaaaaaagttacagaagtgcgaggatacacaaaaggcggcccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggttaagaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaagacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctggacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgctagagaagaaaatcacacaatggttggaaaccaaaggagtggagagattaaaaagaatggccatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaggaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttaccgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggtgatgaagaatttctggactacatgccttcgatgaagagattcaggaaggaggaggagacagagggagccatttggtaa

SEQ ID NO: 1618 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcctctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagctgtcttgcccgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagctctgacaggagctacagagattcaaaactcaggaggtacaaacatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggctactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttgacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcaccaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgcacctggccgaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcggaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctctttaacatgttcaaacacaattttcacgttgacggttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattttagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggattaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccaacaccggaattggaagaagaaatgttcaaaaagcgaaatctaactataatggatcttcatcctgggtcaggaaagacgcggaaatatcttccagctatcgtcagagaagcaatcaagagacgcctaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttgataataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctcttcgaaccagagagggagaagtcagccgctatagacggtgaataccgcctgaagggtgagtccaggaagactttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacctattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacattggccgcgatagtagcagctaatgaaatgggattattggaaaccacaaagagagatctaggaatgtctaaagaaccaggtgttgtttctccaaccagctatttagatgtagacttgcacccagcatcagcctggacattgtacgccgtggccacaacagtgataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttttgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgatctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgctggactgaaaaaagttacagaagtgcgagggtacacaaaaggcggtccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaaatgtgattgagcacttagaaagactacaaagaaaatatggaggaatgcttgtgagaaacccactctcacgaaactccacgcatgaaatgtactggatatccaatggtaccggcaacatcgtctcctcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggctatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 1619 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggtcaaggaccaatgaaattggttatggcgttcatagctttcctcagatttctagccattccaccaacagcaggagtcttggctagatggggaaccttcaagaagtcaggggctattaaggtcctaaaaggcttcaagaaggagatttcaaacatgctgagcataatcaacaaaaggaaaaagacatcgctctgtctcatgatgatgttaccagcaacacttgctttccacttgacttcacgcgatggagagccgcgcatgattgtggggaagaatgaaagagggaaatccttactttttaagacagcctctggaatcaacatgtgcactctcatagctatggacttgggagagatgtgtgatgacacggtcacttataaatgccccctcattgctgaagtggaacctgaagacattgactgctggtgcaaccttacatcgacatgggtgacttatggaacgtgcaatcaagctggggagcatagacgtgacaagagatcagtggcgttagctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgctcgagcacggtgggtgtgtgaccaccatggctaagagcaagcctacgctggacatagagcttcagaagaccgaggccacccaactggcgaccctaaggaagttatgcattgagggaaaaattaccaacataacaactgactcaaggtgtcctacccaaggggaagcgactctacctgaggagcaggaccagaactacgtatgtaagcacacatacgtggatagaggttggggaaacggttgtggtttgtttggaaaaggaagcttggtgacatgcgcgaaatttcagtgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagctgtcttgcccgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagctctgacaggagctacagagattcaaaactcaggaggtacaaacatttttgcggggcatttgaaatgtagacttaagatggacaaactggaactcaaggggatgagctatgcaatgtgcttgaatacctttgtgttgaagaaagaagtctccgaaacgcagcatgggacaatactcattaaggttgagtacaaaggggaagatgcaccttgcaaaattcctttctccacagaggatggacaagggaaagcccacaatggtagattgatcacagccaacccagtggtgaccaagaaggaggagcctatcaacattgaggctgaacctccttttggggaaagcaacatagtgattggaattggagacaaagccttgaaaattaactggtacaagaagggaagctcgattgggaagatgttcgaggctactgccagaggtgcaaggcgcatggccatcttgggagacacagcctgggactttggttcagtgggtggtgttctaaattcattagggaaaatggtgcaccaaatattcggaagtgcttacacagccctgtttagcggagtctcatggataatgaaaattggaataggtgtcctcttgacctggatagggttgaattcaaaaaacacttccatgtcattttcatgcattgtgataggaattatcacactctatctgggagccgtggtacaggctgacatggggtgcgtcataaactggaaaggaaaagaactcaaatgtggaaatggaatttttgtcaccaatgaggtccacacttggacagagcaatacaaatttcaagcagactcccccaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgcacctggccgaaatcacacactctttggagcaatggtgtactagagagtgacatgatcatcccaaagagtctagctggtcctatttcacaacacaaccataggcccgggtaccacacccaaacggcaggaccttggcacttgggaaaattggagctggactttaactattgtgaaggaacaacagtagtcatcgcggaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttccgacaggatgggaatgggcgttacctatttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcattagtctctttaacatgttcaaacacaattttcacgttgacggttgcctggagaacagccaccttgattctggccggagtttcgcttttgccactgtgccagtcttcgagcatgaggaaaacagattggctcccaatgactgtggcagctatgggagtcccacccttaccactttttatcttcagcttgaaggacacacccaaaaggaagagctggccactgaatgagggagtgatggctgttgggcttgtgagcattttagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatttttgggaaaacccaagtgggggttggagtgcagaaagaaggagttttccataccatgtggcacgtcacaagaggggcagtattgacgcacaatgggaaaagactggaaccaaactgggccagcgtgaaaaaagatctgatttcatacggaggaggatggagattgagcgcacaatggcaaaagggagaggaggtgcaggttattgccgtagagcctgggaagaacccaaaaaactttcaaaccatgccgggcatttttcagacgacaacgggggaaataggagcaattgcactagacttcaagcctggaacttcaggatctcctatcataaacagagagggaaaggtagtgggactgtatggcaatggagtggttacaaaaaatggtggctacgtcagtggaatagcgcaaacaaatgcagaaccagacggaccaacaccggaattggaagaagaaatgttcaaaaagcgaaatctaactataatggatcttcatcctgggtcaggaaagacgcggaaatatcttccagctatcgtcagagaagcaatcaagagacgcctaagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttactatcaccagtcagggttccaaattacaatttgataataatggatgaggcccatttcacagacccagccagtatagcggctagagggtacatatcaactcgtgtaggaatgggagaggcagctgcaattttcatgacagcaacaccccctggaactgctgaagcttttccccagagcaacgctccaattcaagatgaagaaagggatattccggaacgctcatggaattcaggcaatgaatggattaccgactttgttgggaagacggtgtggtttgtccctagcatcaaagccggaaatgacatagcaaactgcctgcggaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaatcttgacagatggacccgagcgagtgatcctggctggaccaatgccagttaccgcagcgagcgctgcgcaaaggagagggagagttggcaggaacccacaaaaggaaaatgaccagtacatattcacgggccagcctctcaacaatgacgaagaccatgcccactggacagaagcaaaaatgctgctagacaacattaacacaccagaagggatcataccagctctcttcgaaccagagagggagaagtcagccgctatagacggtgaataccgcctgaagggtgagtccaggaagactttcgtggaactcatgaggaggggtgacctcccagtttggctagcccataaagtagcctcagaagggatcaaatacacagatagaaaatggtgctttgatggagaacgtaataatcaaattttggaggagaacatggatgtggaaatctggacaaaggaaggagaaaggaaaaaactgagacctaggtggcttgatgcccgcacctattcagatcccttagcactcaaggaattcaaggattttgcagctggcagaaagtcaatcgcccttgatcttgtgacagaaataggaagagtgccttcacacttagcccacagaacgagaaacgccctggacaacttggtgatgctgcacacgtcagaacatggcggtagggcctacaggcatgcagtagaggaactaccagaaacaatggaaacactcctactcttgggactcatgatcttattaacaggtggagcaatgcttttcttgatatcaggtaaagggattggaaagacttcaataggactcatttgtgtcattgtttccagtggcatgttatggatggctgatgtcccacttcaatggatcgcgtcagctatagtcctggaatttttcatgatggtgttgctcataccagaaccagaaaaacaaagaactccccaagacaaccaactcgcatatgtcgtgataggcatacttacactggccgcgatagtagcagctaatgaaatgggattattggaaaccacaaagagagatctaggaatgtctaaagaaccaggtgttgtttctccaaccagctatttagatgtagacttgcacccagcatcagcctggacattgtacgccgtggccacaacagtgataacaccaatgttgagacataccatagagaattccacagcaaatgtttccctggcagccatagctaaccaggcagtggtcctgatgggtttagacaaaggatggccaatatcgaaaatggacctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggacgggataatgacaatagacctagatcctgtaatctacgattcaaaattcgaaaagcaactaggacaggtcatgctcttggttttgtgtgcagttcaacttttgttaatgagaacatcatgggccttgtgtgaagctctaaccctagccacaggaccaataacaacactctgggaaggatcacctggaaagttttggaacaccacgatagctgtttccatggccaacatctttagagggagctacttagcaggagctgggcttgctttttctatcatgaaatcagttggaacaggaaggagaggaacggggtcacaaggcgaaaccttaggagaaaagtggaaaaagaaattaaatcagttatcccggaaagagtttgatctttacaagaaatctggaatcactgaagtggatagaacagaagccaaagaagggttgaaaagaggagaaacaacacatcatgctgtgtccagaggcagcgcaaaacttcaatggttcgtggagaggaacatggtcattcccgaaggaagagtcatagacttaggctgtggaagaggaggctggtcatattattgcgctggactgaaaaaagttacagaagtgcgagggtacacaaaaggcggtccaggacacgaagaaccagtacctatgtctacatacggatggaacatagtcaagttaatgagtggaaaggacgtgttctatcttccacctgaaaagtgtgacaccctattgtgtgacattggagaatcttcaccaagcccaacagtggaagaaagcagaactataagagttttgaagatggttgagccatggctaagaaacaaccagttttgcattaaagtattaaacccttacatgccaaatgtgattgagcacttagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacacaggagacccaccatagagaaagatgtggatctgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagacacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagcgcgagagctgctgttgaggacgaggaattctggaaacttgtggacaaagaacgtgaactccacaaattgggcaagtgtggaagctgcgtctacaacatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggctgggacacaagaataacagaagatgacctgcacaatgaggaaaaaatcacacagcaaatggaccctgaacacagacaattagcgaacgccatatttaagctcacatatcaaaacaaagtggtcaaagttcaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcggaggcagacctcgagaaccctcatctgctagagaagaaaatcacacaatggttggaaaccaaaggagtggagagattaaaaagaatggctatcagcggggatgattgcgtggtgaaaccgatcgatgacaggtttgccaatgccctgcttgccctgaacgacatgggaaaggttaggaaggacataccccaatggcagccatcaaaggggtggcatgattggcaacaggtccctttctgctcccaccactttcatgaactgatcatgaaagatggaagaaagttggtggttccctgcagaccccaggacgaactaataggaagggcgagaatctctcaaggagcaggatggagccttaaagaaactgcatgtctagggaaagcttacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaattcctggactacatgccttcgatgaagagattcaggaaggaggaggagtcagagggagccatttggtaa

SEQ ID NO: 1620 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagctttcctcagatttctagccattccaccaacagcaggagtcttggctagatggggaaccttcaagaagtcaggggctattaaggtcctaaaaggcttcaagagggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcattagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctccttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacccacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatctttagcttgaaggacacacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtatataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaatcgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttatcgtttccagtggtatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccctggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaaggcagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgaccacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1621 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggctttcatagctttcctcagatttctagccattccaccaacagcaggagtcttggctagatggggaaccttcaagaagtcaggggctattaaggtcctaaaaggcttcaagagggagatttcaaacatgctgagcattatcaacaaaaggaaaaagacatcgctctgtctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcggctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacgcagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttcttgtaacattcaaaaatgcacatgcaaaaaagcaagaagtagttgtccttggatcgcaagagggagcaatgcacacagcgctgacaggagctacggagattcaaaactcaggaggtacaagcatttttgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgatcacagccaacccagtggtgaccaagaaggaggagcctgtcaacattgaggctgaacctccttttggggaaagcaacatagtgattggaattggagacaaagccttgagaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgaatggtgttgccgctcgtgcacacttcctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacacacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaaacaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagatctgatttcatacggaggaggatggagattgagcacacaatggcaaaaaggagaggaggtacaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaatatcaacacaccagaagggatcataccagctctctttgaaccagagagggagaagtcagccgctatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaatcgccattgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtggccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatttagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcaaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggatatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1622 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggccttcatagctttcctcagatttctagccattccaccaacagcaggagtcttggctagatggggaaccttcaagaagtcaggggctattaaggtcctaaaaggcttcaagagggagatttcaaacatgctgagcattatcaacaaaaggaaaaagacatcgctctgcctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgtcgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcagctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgttagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacacagggagtcacggttgagataacaccccaggcatcaaccgttgaagctgtcttgcctgagtatggaacccttgggctagaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttctcgtaacattcaaaaatgcacatgcaaaaaagcaagaagtagttgtccttggatcgcaagagggagcaatgcacacagcgctgacaggagctacggagattcaaaactcaggaggtacaagcattttcgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgattacagccaacccagtggtgaccaagaaggaggagcctgtcaacattgaggctgaacctccttttggggaaagcaacatagtgattggaattggagacaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgagtggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttgactttgggattcttcctgaggaaattgacatctagagaaaatttgctgttgggagttgggttggccatggcaacaacgttacaactgccagaggacattgaacaaatggcgaatggaattgctctggggctcatgactctaaaactgataacgcaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacgcacccaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgttggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagacctgatttcatacggaggaggatggagattgagcacacaatggcaaaagggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgtttaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtcttaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgccatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaattgcccttgatcttgtgacagaaataggaagagtgccttcacacttagcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcaatagtagcagctaatgaaatgggattattggaaactacaaagagagatttaggaatgtctaaagaaccaggtgttgtttctccaaccagctatttagatgtagacttgcacccagcatcagcctggacattgtacgccgtagccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacagtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatctagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccggaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcgaaaggcagtagagctatatggtacatgtggttgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggactgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1623 - DNA, 10173 bp, Dengue virus
atgaacaaccaacggaaaaagacgggaaaaccgtctatcaatatgctgaaacgcgtgagaaaccgtgtgtcaactggatcacagttggcgaagagattctcaagaggattgctgaacggccaaggaccaatgaaattggttatggccttcatagctttcctcagatttctagccattccaccaacagcaggagtcttggctagatggggaaccttcaagaagtcaggggctattaaggtcctaaaaggcttcaagagggagatttcaaacatgctgagcattatcaacaaaaggaaaaagacatcgctctgcctcatgatgatgttaccagcaacacttgctttccacttgacttcacgcgatggagagccgcgcatgattgtggggaagaatgaaagagggaaatccctactttttaagacagctactggaatcaacatgtgcacactcatagctatggacttgggagagatgtgtgatgacacggtcacttataaatgccccctcattgccgaagtggaacctgaagacattgactgctggtgcaaccttacatcgacatgggtgacttacggaacgtgcaatcaagctggggagcatagacgcgacaagagatcagtggcgttagctccccatgtcggcatgggactggacacacgtacccaaacctggatgtcagctgaaggagcttggagacaagtcgagaaggtagagacatgggctcttaggcacccaggtttcaccatactagctctatttcttgctcattacataggcacttccctgatccagaaagtggtcatttttatactactaatgctggtcactccatccatgacaatgagatgcgtgggagtaggaaacagagattttgtggaaggtctgtcaggagctacgtgggttgatgtggtgctagagcacggtgggtgtgtgaccaccatggctaagaacaagcctacgctggacatagagcttcagaagaccgaggccacccaactggcgaccctaaggaagttatgcattgagggaaaaattaccaacataacaactgactcaaggtgtcctacccagggggaagcgattttacctgaggagcaggaccagaactacgtatgtaagcacacatacgtggatagaggttggggaaacggttgtggtttgtttggaaaaggaagcttggtgacatgcgcgaaatttcaatgtctagaaccaatagagggaaaagtggtgcaatacgagaacctcaaatacactgtcatcatcacagtgcacacaggagaccaacaccaggtgggaaatgacacacagggagtcacggttgagataacaccccaggcatcaaccgttgaagctgtcttgcctgagtatggaacccttgggctggaatgctcaccacggacaggcttggatttcaatgaaatgattttattgacaatgaagaacaaagcctggatggtacataggcaatggttctttgacctacccctaccatggacatcaggagcaacaacagagacaccaacttggaacaggaaagagcttctcgtaacattcaaaaatgcacatgcaaaaaagcaagaagtagttgtccttggatcgcaagagggagcaatgcacacagcgctgacaggagctacggagattcaaaactcaggaggtacaagcattttcgcggggcacttgaaatgtaggcttaagatggacaaattggaactcaaggggatgagctatgcaatgtgcttgaatacctttgtgttgaagaaagaagtctccgagacgcagcatgggacaatactcattaaggttgagtacaaaggggaagatgcaccttgcaagattcctttctccacagaggatggacaagggaaagcccacaatggtagactgattacagccaacccagtggtgaccaagaaggaggagcctgtcaacattgaggctgaacctccttttggggaaagcaacatagtgattggaattggagaaaaagccttgaaaattaactggtacaagaagggaagctcgattgggaagatgtttgaggccactgccagaggtgcaaggcgcatggccatcttgggagacacagcctgggactttggttcagtgggtggtgttctaaattcattagggaaaatggtgcaccaaatattcggaagcgcttacacagccctgtttagcggagtctcatggataatgaaaattggaataggtgtcctcttaacctggatagggttgaattcaaaaaacacttccatgtcattttcatgcattgtgataggaattattacactctatctgggagccgtggtacaagctgacatggggtgtgtcataaactggaaaggaaaagaactcaaatgtggaagtggaattttcgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggcgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaatcacaggcccgggtaccacacccaaacggcaggaccttggcacttgggaaaactggagctggatttcaactattgtgaaggaacaacagtagtcatcacagaaaactgtgggacaagaggcccatcattgagaacaacaacagtgtcagggaagctgatacacgagtggtgttgccgctcgtgcacactccctcccttgcgatacatgggagaggacggctgctggtatggcatggaaattagacctatcaatgagaaagaagagaacatggtaaagtctttagtctcagcagggagtggaaaggtggacaacttcacaatgggagtactgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacctagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacggcactagtctccttaacatgttcaaacacaattttcacgttgactgttgcctggagaacagccaccttgattctggccggagtttcgcttttgccactgtgccagtcttcgagcatgaggaaaacagattggctcccaatgactgtggcagctatgggagttccacccttaccactttttatcttcagcttgaaggacgcacctaaaaggaggagctggccactgaatgagggagtgatggctgtcgggcttgtgagcattctggctagttctctccttaggaatgatgtgcccatggctggaccactagtggccgggggcttgttgatagcgtgctatgtcataactggcacgtcagcagacctcactgtagaaaaagcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcatctttccatactccatacccgccacactgctggtctggcatacttggcaaaagcaaacccaaagatctggcgttctatgggacgtacccagccccccagaaacacagaaagcagaactggaagagggggtctataggatcaaacaacaaggaatctttgggaaaacccaagtgggggttggagtgcagaaagaaggagtcttccacaccatgtggcacgtcacaagaggggcagtgttgacgcacaatgggaaaagactggaaccaaactgggcaagtgtgaaaaaagacctgatttcatacggaggaggatggagattgagcacacaatggcaaaaaggagaggaggtgcaggttattgccgtagagcctgggaagaacccaaaaaactttcaaaccatgccgggcatttttcagacaacaacgggggaaataggagcaattgcactagacttcaagcctggaacttcaggatctcctatcataaacagagagggaaaggtagtgggattgtatggcaatggagtggttacaaaaaatggtggctacgtcagtggaatagcgcaaacaaatgcagaaccagacggaccgacaccggaattggaagaagaaatgtttaaaaagcgaaatctaaccataatggatcttcatcctgggtcaggaaagacgcggaaatatcttccagccatcgtcagagaagcaatcaagagacgcttaagaactctaattttggcaccaacaagagtggttgcagctgagatggaagaagcactgaaaggactcccaataagatatcaaacaaccgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccctggaactgctgaagcctttccccagagcaacgctccaattcaagatgaagaaagggatattccggaacgctcgtggaattcaggcaatgaatggattaccgactttgttgggaagacggtgtggtttgtccctagcatcaaagccggaaatgacatagcaaactgcctgcgaaaaaatggaaaaaaggtcatccaacttagtaggaagacttttgatacagaatatcaaaagaccagactgaatgattgggacttcgtggtgacaacagacatttcagaaatgggagctaactttaaagcagatagagtgattgacccaagaagatgtctcaagccagtaattttgacagatggacccgagcgagtgatcctggccggaccaatgccagtcaccgcagcaagcgctgcgcaaaggagagggagagttggcaggaacccacaaaaagaaaatgaccagtacatattcacgggccagcctcttaacaatgacgaagaccatgctcactggacagaagcaaaaatgctgctagacaacatcaacacaccagaagggatcataccagctctctttgaaccagagagggagaagtcagccgccatagacggtgaataccgcctgaagggtgagtccaggaagaccttcgtggaactcatgaggaggggtgacctcccagtttggctagcccataaagtagcctcagaagggatcaaatacacagatagaaaatggtgctttgatggagaacgtaataaccaaattttagaggagaacatggatgtggaaatctggacaaaggaaggagaaaggaaaaaattgagacctaggtggcttgatgcccgcacttattcagatcccttagcactcaaggaattcaaggattttgcagctggcaggaagtcaattgcccttgatcttgtgacagaaataggaagagtgccttcacacttggcccacagaacgagaaacgccctggacaatttggtgatgctgcacacgtcagaacatggcggtagggcctacaggcatgcagtggaggaactaccagaaacaatggaaacactcctactcttgggactcatgatcttattaacaggtggagcaatgcttttcttggtatcaggtaaagggattggaaagactacaataggactcatttgtgttattgtttccagtggcatgttatggatggctgatatcccacttcaatggatcgcgtcggctatagtcctggaatttttcatgatggtgttgctcataccagaaccagaaaaacaaagaactccccaagacaaccaactcgcatatgtcgtgataggcatactcacactggctgcgatagtagcagctaatgaaatgggattattggaaactacaaagagagatttaggaatgtctaaagaaccaggtgttgtttctccaaccagctatttagatgtagacttgcacccagcatcagcctggacattgtacgccgtagccacaacagtaataacaccaatgttgagacataccatagagaattccacagcaaatgtgtccttggcagccatagctaaccaggcagtggtcctgatgggtttagacaaaggatggccaatatcgaaaatggacttaggcgtaccgctactggcactgggctgctattcacaagtgaacccactgactctcacagcggcagtacttctgctagtcacacattatgccattataggtccaggattgcaggctaaagccactcgtgaagctcaaaaaagaacagctgctggaataatgaagaatccaacagtggatgggataatgacaatagacctagatcctgtaatatacgattcaaaattcgaaaagcaactaggacaggtcatgctcctggttctgtgtgcagttcaacttttgttaatgagaacatcatgggccttgtgtgaagctctaaccctagccacaggaccaataacaacactctgggaaggatcacctggaaagttttggaacaccacgatagctgtttccatggctaacatctttagagggagctatctagcaggagctgggcttgctttttctatcatgaaatcagttggaacaggaaggagaggaacggggtcacaaggcgaaaccttaggagaaaagtggaaaaagaaattaaatcagttatcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgcgcaggactgaaaaaagttacagaagtgcgaggatacacaaaaggcggcccaggacacgaagaaccagtacctatgtctacatacggatggaacatagtcaagttaatgagtggaaaggacgtgttttatcttccacctgaaaagtgtgacaccctattgtgtgacattggagaatcttcaccaagcccaacagtggaagaaagcagaaccataagagttttgaagatggttgagccatggctaaaaaacaaccagttttgcattaaagtattaaacccttacatgccaactgtgattgagcacctagaaagactacaaagaaaatatggaggaatgcttgtgagaaacccactctcacgaaactccacgcatgaaatgtactggatatccaatggtaccggcaacatcgtctcttcagtcaacatggtatccagattgctactgaacagatttacgatgacacataggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctccatgataaatggagtcgtgaaactcctcacaaaaccatgggatgtggttcccatggtgacacagatggcaatgacagatacaactccatttgggcagcaaagagtattcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaggtcagaaccaacgcggctatgggagctgttttcacagaggagaaccaatgggatagtgcgagagctgctgttgaggacgaggaattctggaaacttgtggacagagaacgtgaactccacaaattgggcaagtgtggaagctgcgtctacaacatgatgggcaagagagagaagaaacttggagagtttggcaaagcgaaaggcagtagagctatatggtacatgtggctgggagctaggttccttgagttcgaagcactcggatttttaaatgaagaccactggttctcgcgtgaaaactcttacagtggagtagaaggagaaggactgcacaagctgggatacattttaagagacatctctaagatacccggaggagccatgtatgctgatgacacagctggttgggacacaagaataacagaagatgacttgcacaatgaggaaaaaatcacacagcaaatggaccctgaacacagacaattagcgaacgccatattcaagctcacataccaaaacaaagtggtcaaagtacaacgaccaactccaaaaggcacggtaatggacatcatatctaggaaagaccaaagaggcagtggacaggtggggacttatggtctgaacacattcaccaacatggaagcccagttagtcagacagatggaaggagaaggcgtgttgtcgaagacagacctcgagaaccctcatctgttagagaagaaaatcacacaatggttggaaaacaaaggagtggagagattaaaaagaatggccatcagcggggatgattgcgtggtgaaaccgatcgatgacaggtttgccaatgccctgcttgccctgaacgacatgggaaaggttaggaaggacatacctcaatggcagccatcaaaggggtggcatgattggcaacaagtccctttctgctcccaccactttcatgaactgatcatgaaagatggaagaaagttggtggttccctgcagaccccaggacgaactaataggaagggcgagaatttctcaaggagcaggatggagccttaaagaaactgcatgtctagggaaagcctacgctcaaatgtggagtctcatgtattttcacagaagagatcttagactggcatccaacgccatttgttcagcagtgccagtccattgggtccctacgagcagaacgacatggtctattcacgctcaccatcagtggatgactacagaagacatgcttactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacagcaatccaacaggtgagaagccttataggcgatgaagaatttctggactacatgccttcgatgaagagattcaggaaggaggaggagtcagagggagccatttggtaa

SEQ ID NO: 1624 - DNA, 10173 bp, Dengue virus
atgaacaaccaacgaaaaaagacgggaaaaccgtctatcaatatgctgaaacgcgtgagaaaccgtgtgtcaactggatcacagttggcgaagagattctcaagaggattgctgaacggccaaggaccaatgaaattggttatggcgttcatagccttcctcagatttctagccattccaccaacagcaggagtcttggctagatggggaaccttcaagaagtcgggggctattaaggtcctaaaaggcttcaagaaggagatttcaaacatgctgagcataatcaacaaaaggaaaaagacatcgctctgcctcatgatgatgttaccagcaacacttgctttccacttgacttcacgcgatggagagccgcgcatgatcgtggggaagaatgaaagagggaaatccttactttttaagacagcttctggaatcaacatgtgcacactcatagctatggacttgggagagatgtgtgatgacacggtcacttataaatgccccctcattgccgaagtggaacctgaagacattgattgctggtgcaaccttacatcgacatgggtgacttatggaacgtgcaatcaagctggggagcatagacgcgacaagagatcagtggcgttggctccccatgttggcatgggactggacacacgtacccaaacctggatgtcggctgaaggagcttggagacaagttgaaaaggtagagacatgggctcttaggcacccaggtttcaccatactagctctatttcttgcccattacataggcacttccctgacccagaaagtggttatttttatactactaatgctggtcactccatccatgacaatgagatgcgtgggagtaggaaacagagattttgtggaaggtctgtcaggagctacgtgggttgatgtggtgcttgagcacggtgggtgtgtgaccactatggctaagaacaagcctacgctggacatagagcttcagaagaccgaggccacccaactggcgaccctaaggaagttatgcattgagggaaaaattaccaacataacaactgactcaaggtgccctacccagggggaagcgattctacctgaggagcaggaccagaactacgtgtgtaagcatacatacgtggatagaggttggggaaacggttgtggtttgtttggaaaaggaagcttggtgacatgcgcgaaatttcaatgtctagaaccaatagagggaaaagtggtgcaatatgagaaccttaaatacactgtcatcatcacagtgcacacaggagaccaacaccaagtgggaaatgacacgcagggagtcacggttgagataacaccccaggcatcaaccgttgaagccgtcttgcctgagtatggaacccttgggctagaatgctcaccacggacaggcttggatttcaatgaaatgattttattgacaatgaaaaacaaagcctggatggtacataggcaatggttctttgacctacccctaccatggacatcaggagctacaacagagacaccaacttggaacaggaaagagcttcttgtaacattcaaaaatgcacatgcaaaaaagcaagaagtggttgtccttggatcgcaagagggagcaatgcacacagcgctgacaggagctacagagattcaaaactcaggaggtacaagcatttttgcggggcacttgaaatgtagacttaagatggataaattggaactcaaggggatgagctatgcaatgtgcttgaatacctttgtgttgaagaaagaagtctccgaaacgcagcatgggacaatactcattaaggtcgagtacaaaggggaagatgcaccttgcaagattcctttctccacagaggatggacaagggaaagcccacaatggtagattgatcacagccaacccagtggtgaccaagaaggaggagcctgtcaacattgaggctgaacctccttttggggaaagcaacatagtgattggaattggagacaaagccttgaaaattaactggtacaagaagggaagctcaattgggaagatgttcgaggccactgccagaggtgcaaggcgcatggccatcttgggagacacagcctgggactttggttcagtgggtggtgttctaaattcactagggaaaatggtgcaccaaatattcggaagtgcttacacagccctgtttagtggagtctcatggataatgaaaattggaataggtgtcctcttaacctggatagggttgaattcaaaaaacacttccatgtcattttcatgcattgtgataggaattatcacactctatctgggagccgtggtacaagctgacatggggtgcgtcataaactggaaaggaaaagaactcaaatgtggaagtggaatttttgtcactaatgaggtccacacctggacagagcaatacaaatttcaagcagactcccctaaaagactggcgacagccatcgcaggcgcttgggaaaatggagtctgtggaatcaggtcaacaaccagaatggagaatctattgtggaagcaaatagccaatgagctgaactacatattatgggaaaacaacatcaaattaacggtagttgtgggtgacataattggggtcttagagcaagggaaaagaacactaacaccacagcccatggagctaaaatattcatggaaaacatggggaaaggcaaaaatagtgacagctgaaacacaaaattcctctttcataatagatgggccaaacacaccggagtgtccaagtgcctcaagagcatggaatgtgtgggaggtggaagattacgggtttggagtcttcacaaccaacatatggctgaaactccgagaggtgtacacccaatcatgtgaccataggctaatgtcggcagccatcaaagatgagagggccgtgcatgccgacatgggctattggatagaaagccaaaagaatggaagttggaagctagaaaaagcatccttcatagaggtgaaaacctgtacttggccaaaatcacacactctttggagcaatggtgtactagagagtgacatgatcatcccaaagagtctagctggtcctatttcacaacacaaccacaggcctgggtaccacacccaaacggcaggaccttggcacttgggaaaattggagctggactttaactattgtgaaggaacaacagtagtcatcacagaaaactgtgggacaagaggcccatcattgagaacaacaacagtgtcagggaagctgatacacgaatggtgttgccgctcatgcacacttcctcccttacgatacatgggagaggacggctgctggtatggcatggaaattagacctatcaatgagaaagaagagaacatggtaaagtctttagtctcagcagggagtggaaaggtggacaacttcacaatgggagtcctgtgtttggcaatcctcttcgaagaggtgatgagaggaaaatttgggaaaaaacacatgattgcaggggttctcttcacgtttgtgctccttctctcagggcaaataacatggagagatatggcacacacactcataatgattgggtccaacgcttctgacaggatgggaatgggcgttacctacttagctttaattgcaacattcaaaatccagccattcttggctttgggattcttcctgaggaaattgacatctagagaaaatttgctgttgggagttgggttggccatggcaacaacgttacaactgccagaggacattgaacaaatggcgaatggaattgctctggggctcatgactctaaaactgataacacaatttgagacatatcagttgtggacagcattagtctccttaacatgttcaaacacaattttcacgctgactgttgcctggagaacagccaccttgattctggccggagtttcgcttttgccactgtgccagtcttcgagcatgaggaaaacagattggctcccaatgactgtagcagctatgggagttccacccttaccactttttatcttcagcttgaaggacacaccaaaaaggaggagctggccactgaatgagggggtgatggctgttgggcttgtgagcattctagctagttctctccttaggaatgatgtgcccatggctggaccactagtggccgggggcttgttgatagcgtgctatgtcataactggcacgtcagcagacctcactgtagaaaaggcagcagatgtaacatgggaggaagaggctgagcaaacaggagtgtcccacaatttgatgatcacagttgatgatgatggaacaatgagaataaaggatgatgagactgagaacatcctaacagtgctcttaaaaacagcattactaatagtatcaggcgtctttccatactccatacccgccacactgttggtctggcatacttggcaaaagcaaacccaaagatctggcgttctatgggacgtacccagccccccagaaacacagaaagcagaactggaagagggggtttataggatcaaacaacaaggaatttttgggaaaacccaagtgggggttggagtgcagaaagaaggagtcttccacaccatgtggcacgtcacaagaggggcagtgttgacgcacaatgggaaaagactggaaccaaactgggccagtgtgaaaaaagatctgatttcatacggaggaggatggagattgagcgcacaatggcaaaaaggagaggaggtgcaggttattgccgtagagcctgggaagaacccaaaaaacttccaaaccatgccgggcatttttcagacaacaacgggggaaataggagcaattgcactagacttcaagcctggaacttcaggatctcctatcataaacagagagggaaaggtagtgggactgtatggcaatggagtggttacgaaaaatggtggctacgtcagtggaatagcgcaaacaaatgcagaaccagacggaccgacaccggaattggaagaagaaatgttcaaaaagcgaaatctaaccataatggatcttcatcctgggtcaggaaagacgcggaaatatcttccagccatcgttagagaagcaatcaagagacgtttgagaactctaattttggcaccaacaagagtggttgcagctgagatggaagaagcactgaaaggactcccaataaggtatcaaacaactgcaacaaaatctgaacacacaggaagggagattgttgatctaatgtgccacgcaacattcacaatgcgcttgctatcaccagtcagggttccaaattacaatttgataataatggatgaggcccatttcacagatccagccagtatagcggctagagggtacatatcaactcgtgtaggaatgggagaggcagctgcaattttcatgacagcaacaccccccggaactgctgaagcctttccccagagcaacgctccaattcaagatgaagaaagggatattccggaacgctcatggaattcaggcaatgaatggattaccgactttgttggaaagacggtgtggtttgtacctagcatcaaagccggaaatgacatagcaaactgcctgcggaaaaatgggaaaaaggtcatccaacttagtagaaagacttttgatacagaatatcaaaagaccaaactgaatgattgggacttcgtggtgacaacagacatttcagaaatgggagctaactttaaagcagatagagtgattgacccaagaagatgtctcaagccggtaattttgacagatggacccgagcgagtgatcctggctggaccaatgccagtcaccgcagcgagcgctgcgcaaaggagagggagagttggcaggaacccacaaaaggaaaatgaccagtacatattcacgggccagcctctcaacaatgacgaagaccatgctcactggacagaagcaaaaatgctgctagacaacatcaacacaccagaagggatcataccagctctatttgaaccagagagggagaagtcagccgctatagacggtgaataccgcctgaagggtgagtccaggaagaccttcgtggaactcatgaggaggggagacctcccagtttggctagcccacaaagtagcctcagaagggatcaaatacacagacagaaaatggtgctttgatggagaacgtaataatcaaattttagaggagaacatggatgtggaaatctggacaaaggaaggagaaaggaaaaaattgagacctaggtggcttgatgcccgcacttattcagatcccttagcactcaaggaattcaaggattttgcagctggcagaaagtcaatcgcccttgatcttgtgacagaaataggaagagtgccttcacacttagcctacagaacgagaaacgccctggacaacttggtgatgctgcacacgtcagaacatggcggtagggcctacaggcatgcagtggaggaactaccagaaacaatggaaacactcctactcttgggactcatgatcttattaacaggtggagcaatgcttttcttgatatcaggtaaagggattggaaagacttcaataggactcatttgtgttattgtttccagtggcatgttatggatggctgatgtcccacttcaatggatcgcgtcggctatagtcctggaatttttcatgatggtgttgctcataccagaaccagaaaaacaaagaactccccaagacaaccaactcgcatatgtcgtgataggcatactaacactggctgcgatagtagcagctaatgaaatgggattattggaaactacaaagagagacttaggaatgtctaaagaaccaggcgttgtttctccaaccagctatttagatgtagacttgcacccagcatcagcctggacattgtacgccgtggccacaacagtaataacaccaatgttgagacataccatagagaattccacagcaaatgtatccctggcagccatagctaaccaggcagtggtcctgatgggtttagacaaaggatggccaatatcgaaaatggatctaggcgtaccgctactggcactgggctgctattcacaagtgaacccactgactctcacagcggcagtacttctgctagttacacattatgccattataggtccaggattgcaggctaaagccactcgtgaagctcaaaaaagaacagctgctggaataatgaagaatccaacggtggatgggataatgacaatagacctagatcctgtaatatacgattcaaaattcgaaaagcaactaggacaggtcatgctcctggttctgtgtgcagttcaactcttgttaatgagaacatcatgggcattgtgtgaagctctaaccctagccacaggaccaataacaacactctgggaaggatcacctggaaagttttggaacaccacgatagctgtttccatggctaacatctttagagggagctacttagcaggagctgggcttgctttttctatcatgaaatcagttggaacaggaaggagaggaacggggtcacaaggcgaaaccttaggagaaaagtggaaaaagaaattaaatcagttgtcccggaaagagtttgacctttacaagaaatctggaatcactgaagtggatagaacagaagccaaagaagggttgaaaagaggagaaacaacacatcatgccgtgtccagaggcagcgcaaaacttcaatggttcgtggagaggaacatggtcattcccgaaggaagagtcatagacttaggctgtggaagaggaggctggtcatattactgtgcaggactgaaaaaagttacagaagtgcgaggatacacaaaaggtggcccaggacacgaagaaccagtacccatgtccacatacggatggaatatagtcaagctaatgagtggaaaggacgtgttttatcttccacctgaaaagtgtgacaccctattgtgtgacattggagaatcttcaccaagcccaacagtggaagaaagcagaactataagagtcttgaagatggttgagccatggctaaaaaacaaccagttttgcattaaagtattaaacccttacatgccaactgtgattgagcacctagaaagattacaaagaaaatatggaggaatgcttgtgagaaacccactctcacgaaactccacgcatgaaatgtactggatatccaatggtactggcaacatcgtctcttcagtcaacatggtatccagattgctgctgaacagatttacgatgacacacaggagacccaccatagagaaagatgtggatttgggagcaggaactcgacatgtcaatgcggaaccagaaacacccaacatggacgtcattggagaaagaataaaaaggatcaaggaggagcatagttcaacatggcactatgatgatgaaaatccttacaaaacgtgggcttaccatggatcctatgaagtcaaagccacaggctcagcctcctctatgataaatggagtcgtgaaactcctcacaaaaccatgggatgtggttcccatggtgacacagatggcaatgacagatacaactccatttgggcagcaaagagttttcaaagagaaagtggacaccaggacacccaggcccatgccagggacaagaaaggttatggagattacagcggaatggctttggagaaccctgggaaggaacaaaaaacccagattgtgcacaagggaagagttcacaaaaaaagtcagaaccaacgcggctatgggagctgttttcacagaggagaaccaatgggatagcgcgagagctgctgttgaggacgaggaattctggaaacttgtggacagagaacgtgaactccacaaattgggcaagtgtggaagctgcgtctacaatatgatgggcaagagagagaagaaacttggagagtttggcaaagcaaaaggcagtagagccatatggtacatgtggttgggagccaggtaccttgagttcgaagcactcggatttttaaatgaagaccactggttctcgcgtgaaaactcttacagtggagtagaaggagaaggactgcacaagctgggatacattttaagagacatttctaagatacccggaggagccatgtatgccgatgacacagctggttgggacacaagaataacagaagatgacctgcacaatgaggaaaaaatcacacagcaaatggaccctgaacacagacaattagcgaacgccatatttaagctcacataccaaaacaaagtggtcaaagtacaacgaccaactccaaaaggcacggtaatggacatcatatctagaaaagaccaaagaggcagtggacaggtggggacttatggtctgaacacattcaccaacatggaagcccagttagtcagacagatggaaggagaaggcgtgttgtcgaaggcagacctcgagaacccccatctgctagagaagaaaatcacacaatggttggaaaccaaaggagtggagagattaaaaagaatggccatcagcggagatgattgtgtggtgaaaccgattgatgacaggtttgccaatgccctgcttgccctgaacgacatgggaaaggttaggaaggacatacctcaatggcagccatcaaaggggtggcatgattggcaacaggtccctttctgctcccaccactttcatgaactgatcatgaaagatggaagaaagttggtggtcccctgcagaccccaggacgaactaataggaagggcgagaatttctcaaggagcaggatggagccttaaagaaaccgcatgtctagggaaagcctacgctcaaatgtggagtctcatgtattttcacagaagagatcttagactagcatccaacgccatttgttcagcagtaccagtccattggatccctacaagcagaacgacatggtctattcacgctcaccatcagtggatgactacagaagacatgctaactgtctggaacagggtgtggatagaggacaatccatggatggaagacaaaactccagtcacaacttgggaagatgttccatacctagggaagagagaagatcaatggtgcggatcactcattggtctcacttccagagcaacctgggcccagaacatactcacggcaatccaacaggtgagaagccttataggcgatgaagaatttctggactacatgccttcgatgaagagattcaggaaggaggaggagtcagagggagccatttggtaa

SEQ ID NO: 1625 - DNA, 10173 bp, Dengue virus; identical to SEQ ID NO: 1507

SEQ ID NO: 1626 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgtggcgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcgtagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacgaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatcaagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgcggggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcatacggccataacccaggtcaggaacctgatcggaaaagaggaatacgtggattacatgccagtaatgaaaagatacagtgctccttcagagagtgaaggagttctgtaa

SEQ ID NO: 1627 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1628 - DNA, 10164 bp, Dengue virus
  misc_feature (4728)..(4728): n is a, c, g, or t
atgaaccaacgaaaaaaggtggttagaccacctttcaatatgctgaaacgcgagagaaaccgcgtatcaacccctcaagggttggtgaagagattctcaaccggacttttttccgggaagggacccttacggatggtgctagcattcatcacgtttttgcgagtcctttccatcccaccgacagcagggattctgaaaagatggggacagttgaagaaaaataaggccatcaagatattgattggattcaggaaggagataggccgcatgctgaacatcttgaacgggagaaagaggtcaacgatgacattactgtgtttgattcccaccgtaatggcgttccacttgtcaacaagagatggcgaacccctcatgatagttgcaaaacatgaaagggggagacctctcttgttcaagacaacagaaggaatcaacaaatgcactcttattgccatggacttgggtgaaatgtgtgaggacactgtcacgtataaatgccccctattggtcaataccgaacctgaagacattgattgctggtgcaatctcacgtctacctgggtcatgtatgggacatgcacccagagtggagaacggagacgagagaagcgctcagtagctttaacaccacattcaggaatgggattggaaacaagagctgaaacatggatgtcatcagaaggggcttggaagcatgctcagagagttgagagctggatactcagaaacccaggattcgcgctcttggcaggatttatggcttatatgattgggcaaacaggaattcagcgaactgtcttctttgtcctaatgatgctggtcgccccatcctacggaatgcgatgcgtgggagtaggaaacagagactttgtggaaggagtctcaggcggagcatgggtcgatctggtgctagaacatggaggatgcgtcacaaccatggcccagggaaaaccaactttggattttgaactgactaagacaacagccaaggaagtggctttgttaagaacttattgcattgaagcctcgatatcaaatataaccacggcaacgagatgtccaacgcaaggagagccttatctaaaagaggaacaagaccaacagtacatttgccggagagatgtggtagacagagggtggggcaatggctgtggcttgtttggaaaaggaggagttgtgacatgtgcgaagttttcatgctcagggaagataacaggcaatttggtccaaattgagaaccttgagtacacagtggttgtgacagtccacaatggagacactcatgcggtaggaaatgacacatccaatcatggagtcacagccacgataactcccaggtcaccatcggtggaagtcaaattaccggactatggagaactaacactcgattgtgaacccagatctggaattgactttaatgagatgattctgatggagatgaaaaagaaaacatggcttgtgcataagcaatggtttttggacctacctctaccatggacagcaggagcagacacatcagaagttcactggaattacaaagagagaatggtgacattcaaggttcctcatgccaagagacaggatgtgacagtactgggatctcaggaaggagccatgcattctgccctcgctggagccacggaagtggattccggtgatggaaatcacatgtttgcaggacatctcaagtgcaaagtccgtatggagaaattgagaatcaagggaatgtcatatacgatgtgctcaggaaagttctcaattgacaaagagatggcagaaacacagcatgggacaacagtggtgaaagtcaagtatgaaggtgctggagctccgtgtaaagtccccatagagatacgagatgtaaataaggaaaaagtggttgggcgtgtcatctcatccacccctctagctgagaataccaacagtgtgaccaacatagaactggaacccccctttggggacagttacatagtcataggtgttgggaacagtgcattaacactccattggttcaggaaaggaagttctattggcaagatgtttgagtccacatacagaggtgcaaaacgaatggccattctgggtgaaacagcttgggattttggttccgttggtggactgttcacgtcattgggaaaggctgtgcaccaggtctttggaagtgtgtacacgaccatgtttggaggagtctcatggatggttagaatcctaattgggttcttagtgttgtggattggcacgaactcaagaaacacttcaatggcaatgacgtgcatagctgttggaggaatcaccctgtttctgggcttcacagttcaagcggatatgggttgtgtggtgtcatggagtggaaaagaattaaaatgtggaagcggaatttttgtggctgacaacgtgcacacttggacagaacagtacaaatttcaaccagagtccccagcgagactggcgtctgcaatattgaatgcccacaaagatggggtctgtggaattagatcaaccacgaggctggaaaatgtcatgtggaagcaaataaccaacgagctaaactatgttctctgggaaggcggacatgaccttacagtagtggctggggatgtgaagggggtgttgaccaaaggcaagagagcactcacacctccagtgaatgatctaaaatattcatggaagacatggggaaaagctaaaatctttactccagaagcaagaaatagcacatttctaatagacggaccagacacctctgaatgccccaatgaacgaagagcgtggaactttcttgaggtggaagactatggatttggtatgttcacaactaacatatggatgaaattccgagaaggaagttcagaagtgtgtgaccacaggttaatgtcggcagcaatcaaagatcagaaagctgtgcatgctgacatgggttattggatagaaagttcaaaaaaccagacctggcagatagagaaagcatctcttattgaagtgaaaacatgtctgtggcctaagacccacacattgtggagcaatggagtgctggaaagccagatgctcattccaaaatcatatgcgggccctttttcccagcacaattaccgccagggctatgccacgcaaaccgtaggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttaagtgaaaaagaagagaacatggtcaaatcacaggtaacggccggacagggtacatcagaaactttctctatgggcctattgtgccttaccttgtttatggaagaatgcctgaggagaagagtcactaggaaacacatgatattagttgtggtaatcactctttgtgctatcatcctaggaggcctcacatggatggacttactgcgagccctcatcatgctgggggacaccatgtctggtagaataggaggacaggtccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggccgacataacaggctcaagcccaattatagaagtgaagcaggatgaagatggttctttctccatacgggacgttgaggaaaccaacatgataacccttttggtgaaactggcactgataacagtgtcaggtctctatcccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatagaaggtgtttttcacacaatgtggcatgtgacaagaggatcagtgatctgccatgagactgggagattagagccatcttgggctgacgtcaggaatgacatgatatcatacggtgggggatggaggcttggagacaaatgggacaaagaagaagatgtccaggtcctagctatagaaccnggaaaaaatcccaaacatgtccagacgaaacctggccttttcaagaccctaactggagaaattggggcagtaacattagatttcaaacccggaacgtctggttctcccattattaacaggaaaggaaaggtcattggactatatggaaatggagtagtcaccaaatcaggtgattacgtcagtgccataacgcaagctgaaagaattggagagccagattatgaagtggatgaggacattttccgaaagaaaagactaactattatggacttacaccccggagccggaaagacaaaaagaattctcccatcaatagtgagagaagccttaaaaaggaggttgcgaaccttgattttggctcccacaagagtggtggcggccgagatggaagaggccctacgtggactgccaatccgttatcagaccccagccgtgaaatcagaacacacaggaagagagattgtagaccttatgtgtcatgcaaccttcacaacaagacttctgtcatcaaccagggttccaaattacaaccttatagtgatggatgaagcacatttcaccgatccttctagtgtcgcggctagaggatacatctcgaccagggtggaaatgggggaggcagcggccatcttcatgaccgcaacccctcccggaacgacagatcccttcccccagagcaacagcccaatagaagacatcgagagggaaattccagaaaggtcatggaatacagggttcgactggataacagattaccaagggaaaactgtgtggtttgttcccagcataaaagctgggaatgacattgcaaactgtttgagaaagtcgggaaagaaagttatccagttgagtaggaagacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcccattccagtgactccagcaagcgctgctcagagaagaggacgaataggtaggaacccagcacaagaagacgaccaatacgttttctccggggacccgctaaaaaatgatgaagatcatgcccactggacagaagctaagatgctgcttgacaatatctacaccccagaagggatcattccaacattgtttggtccggaaagggaaaaaacccaggccattgatggagagttccgcctcaggggggaacagaggaagacttttgtggaattaatgaggagaggagaccttccagtgtggctgagctataaggtagcttctgctggcatttcttacaaagatcgggaatggtgcttcacaggggaaaggaataatcagattttagaagaaaacatggaggtagaaatctggactagagagggggaaaagaaaaagctgaggccaaaatggttagatgcacgtgtgtacgctgaccccatggctctgaaggatttcaaagagtttgccagtgggaggaagagcataactcttgacatcctaacagagattgccagtttgccaacttatctttcctctagggccaagctcgcccttgacaacatagttatgctccacacaacagaaaaaggagggagagcctatcaacacgccctgaacgaactcccggagtcactggaaacacttatgcttgtagccttgctaggtgctatgacagcaggcacctttctcttcttcatgcaagggaaaggaatagggaaattgtcaatgggtttgataaccattgcggtggctagcggcttgctctgggtagcagaacttcaacctcagtggatagcggcctcaatcatactggagttctttctcatggtactgttgataccagaaccggaaaaacaaaggaccccacaagacaaccaattgatctacgtcatattgaccattctcaccattattggtctcatagcagccaacgagatggggctgatagaaaaaacaaaaacggattttgggttttaccaagtaaaaacagaaaccaccatcctcgatgtggacttgagaccagcttcagcatggacgctctatgcagtggccaccactattctgacacccatgctgagacataccatagaaaacacgtcggccaacctatctctagcagccattgccaaccaggcagccgtcctaatggggcttggaaaaggatggccgctccacagagtggacctcggtgtgccgctgttagcaatgggatgttactctcaagtgaacccaacaactttgacagcatccttagtcatgcttttagtccattatgcaataataggtccaggattgcaggcaaaagccacaagagaggcccagaaaagaacagctgctgggatcatgaagaaccccacggtggacgggataacagtaatagatctagaaccaatatcctatgacccaaaatttgaaaagcaattagggcaagtcatgctactagtcctgtgtgctggacaactactcttgatgagaacaacgtgggctttctgtgaagtcttgactttggccacaggaccaatcttgaccttgtgggagggcaacccgggaaggttttggaacacgaccatagccgtatccaccgccaatattttcaggggaagttacttggcaggagctggactggctttttcactcataaagaatgcacaaacccctaggaggggaactgggaccacaggagagacactgggagagaagtggaagagacagctaaactcactagataggaaagagtttgaagagtataaaaggagtggaataatagaagtggacaggactgaagccaagtctgccctgaaagatggatccaaaatcaagcatgcagtgtctagagggtctagtaagatcagatggattgttgagagagggatggtaaaaccaaaagggaaagttgtggatcttggttgcgggagaggaggatggtcttattacatggcgactctcaagaacgtgactgaagtgagagggtttacaaaaggaggtccaggacatgaagaacccattcccatggctacttatggctggaatttggtcaaactccattcaggggttgacgtgttctacaaacccacagagcaagtggacaccctgctctgtgatattggggagtcatcttccaatccgacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgttatccaggaactccacccatgagatgtattgggtgtcaggtgcgtcgggaaacattgtgagctctgtgaacacaacatcaaagatgttgttgaacaggttcacaacaaggcataggaaacccacttatgagaaggacgtagaccttggggcaggaacgagaagtgtctccactgaaacagaaaaaccagacatgacaattatagggagaagactccagcgattgcaagaagaacacaaagaaacctggcattatgatcaggaaaacccatacagaacctgggcgtatcatggaagctatgaagctccttcgacaggctcagcatcttccatggtgaacggggtagtgaaactgctaacaaaaccctgggatgtgattccaatggtgactcagttagccatgacagatacaaccccttttgggcaacaaagggtgttcaaagagaaggtagataccagaacaccccaaccaaaacccggcacacgaatggttatgaccacgacagccaattggctgtggaccctccttggaaagaagaagaatcccagactgtgcacaagggaagagttcatttcaaaagttaggtcaaacgcagccataggcgcagtctttcaggaagaacagggatggacatcagccagtgaagctgtgaatgacagccggttttgggaactggttgacaaagaaagggccctgcatcaggaagggagatgtgaatcgtgtgtctataacatgatggggaaacgtgagaaaaaactaggagaatttggcagagccaagggaagccgagcaatctggtacatgtggctgggagcgcggtttctggaatttgaagccctgggttttttgaatgaagaccactggtttggcagagaaaattcatggagtggagtggaaggggaaggtctgcacagattgggatatatcctggaggacatagacaagaaggatggagacctgatgtatgctgatgacacagcaggctgggacacaagaatcactgaggatgaccttcaaaatgaagaactgatcacggaacagatggctccccatcacaagatcctagccaaagccattttcaaattaacctatcaaaacaaagtggtgaaagtcctcagacccacaccaagaggagcggtgatggatatcatatccaggaaggaccaaagaggtagtggacaagttggaacatatggtctgaacacattcaccaacatggaagttcaactcatccgccaaatggaagctgaaggagtcatcacacaagatgacatgcaaaatccaaaagggttgaaagaaagagttgagaaatggctgaaagagtgtggcgtcgacaggttaaagaggatggcaatcagtggagacgattgcgtggtgaaacccctggatgagaggtttagcacttccctcctcttcttgaacgacatgggaaaggtgaggaaagatattccgcagtgggaaccatctaagggatggaaaaactggcaagaggttcctttttgctctcatcactttcacaagatcttcatgaaagatggccgctcattagttgttccatgtagaaaccaagatgaactgatagggagagccagaatctcgcagggggctggatggagcttgagagaaacagcctgtttgggcaaggcttacgcccagatgtggtcgctcatgtacttccacagaagggatctacgtttagcctccatggccatatgctcagcagttccaacggaatggtttccaacaagcagaacaacatggtcaatccacgctcatcatcagtggatgaccactgaagacatgctcaaagtgtggaacagagtgtggatagaagataaccctaatatgactgataagaccccagtccattcatgggaagatgtaccttacctaggaaaaagagaggacttgtggtgtggatccctgatcggactttcttccagagccacctgggcgaagaacattcacacggccataacccaggtcaggaacttgatcggaaaagaggaatacgtggattacatgccagtaatgaaaagatacagcgctccttcagagagtgagggagttctgtaa

SEQ ID NO: 1629 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttagttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaagagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtagtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1630 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttccgggaaaggacccttacggatggtgctagcattcatcacgtttttgcgagtcctttccatcccaccaacagcagggattctgaaaagatggggacagttgaagaaaaacaaggccatcaaaatactgactggattcaggaaggagataggccgcatgctgaacatcttgaatggaagaaaaaggtcaacaatgacattgctgtgcttgattcccaccgcaatggcgtttcacttgtcaacaagagatggcgaaccccttatgatagtggcaagacacgaaagggggagacctctcttgtttaagacaacagagggaatcaacaaatgcactcttattgccatggacctgggtgaaatgtgtgaggacaccgtcacgtatgaatgccctctactggtcaataccgaacctgaggacattgattgctggtgcaatctcacgtctgcctgggtcatgtatgggacatgcactcagagtggggaacggagacgggagaagcgctcagtagccctaacaccacattcaggaatgggattggagacaagggctgagacatggatgtcatcggaaggggcttggaaacatgctcagagggtagagagttggatactcagaaacccaggattcgctctcttggcaggatttatggcctatatgattgggcaaacaggaatccagcgaacagtcttctttgttctaatgatgctggtcgccccatcctacggaatgcgatgcgtgggagtggggaacagagactttgtggaaggagtctcaggtggagcatgggtcgatttggtgctagaacatggaggatgtgtcacaaccatggcccagggaaaaccaaccttggattttgaactgatcaagacaacagccaaggaagtggctctgttaagaacctattgcattgaagcctcgatatcaaacataaccacggcaacaagatgtccaacgcaaggagaaccttatctcaaagaggaacaagatcaacagtacatttgccggagagatgtggtagacagagggtggggcaatggctgtggcttgtttgggaaaggaggagttgtgacatgtgcgaagttttcatgctcggggaagataacaggcaatttggtccaaattgagaaccttgaatacacagtagttgtaacagtccacaatggagacacccatgcagtaggaaatgacatacccaaccatggagtgacagccacgataacccccaggtcaccatcggtagaagttaaattaccggattatggagaattaacactcgattgtgaacccaggtccggaattgattttaatgagatgattctgatgaaaatgaaaaagaaaacgtggcttgtgcacaagcaatggtttttggatctacctctaccatgggcagcaggagcagacacatcagaagttcattggaattacaaagagagaatggtgacattcaaggttcctcatgccaagagacaggatgtgacagtgctaggatctcaggaaggagccatgcattctgccctcaccggagctacagaagtggattccggtgatggaaaccacatgtttgcaggacatctgaaatgcaaagttcgcatggagaaattgagaattaagggaatgtcatacacgatgtgctcaggaaagttctcaattgacaaagagatggcagaaacacagcatgggacaacagtggtaaaagtcaagtatgagggtgctggagctccatgtaaagttcccatagagataagagatgtgaacaaggaaaaagtggtagggcgcatcatctcatctaccccttttgctgagtataccaacagtgtaaccaacatagaattagaacccccctttggggacagctacatagtaataggtgttggagacagtgcattaacactccattggttcaggaaagggagttccattggcaagatgcttgagtccacatacagaggcgcaaagcgaatggccattctaggtgaaacagcctgggattttggttctgttggtggactgctcacatcattgggaaaggctgtacaccaggtttttggtagtgtgtatacaactatgtttggaggagtctcatggatggttagaatcctaattgggttcttagtgttgtggattggcacgaattcgagaaacacctcaatggcaatgacgtgcatagctgttggaggaatcactctgtttctgggtttcacagttcacgcagacacgggttgtgcggtgtcatggagtgggaaagaattgaaatgtggaagcggaatctttgtaattgacaacgtgcacacttggacagaacagtacaaatttcaaccagagtctccagcgagactagcgtccgcaatattgaatgcccacgaagatggggtctgtggaattagatcaaccacgaggctggaaaacatcatgtggaagcaaataaccaacgagttgaactatgttctctgggaaggaggacatgacctcactgtagtggccggggatgtgaaaggggtgctgtccaaaggcaagagagcactcgcacccccagtgaatgatctgaaatattcatggaagacatggggaaaagcaaagatctttactccagaagcaaaaaatagcacatttctaatagacggaccagacacctccgaatgccccaatgaacgaagagcatggaattttcttgaggtagaagactatggatttggcatgtttacgaccaacatatggatgaaatttcgagaaggaagttcagaagtgtgtgaccacaggttgatgtcggcggcaatcaaagaccagaaagctgtgcatgctgacatgggctattggatagagagctcaaaaaaccagacctggcagatagagaaagcatctctcattgaagtgaaaacatgtctgtggcccaagacccacacattgtggagcaatggagtgctagagagccagatgctcatcccaaaagcatatgcaggccctttttcacagcacaattaccgccagggctatgccacgcagaccgtgggcccatggcacttgggcaaattggagatagactttggagaatgccccggaacaacagtcactattcaagaggattgtgaccatagaggcccatctttgaggaccactactgcatctggaaaattggtcacgcagtggtgctgccgctcctgcacgatgcctcccttaaggtttttgggagaggatggatgctggtatgggatggaaattaggcccttgagtgaaaaagaagagaacatggtcaaatcacaggtatcggccggacagggtacatcagaaactttttctatggggctgttatgcctgactttgtttgtggaagaatgcttgaggagaagagtcaccaggaaacacatgatattggttgtggtgaccaccctttgtgccatcatcctaggaggtctcacatggatggacttactacgagctcttatcatgttaggggacaccatgtctggtagaatgggaggacagattcacttagccatcatggcagtgttcaagatgtcaccaggatacgtgctgggtatatttttaaggaaactcacttcaagagagacagcactaatggtgataggaatggccatgacaacggtgctttcaattccacatgaccttatggaattcattgatggaatatcactggggttaatcttattaaaaatggtaacacattttgacaacactcaagtgggaaccttagctctttccttgactttcataagatcaacaatgccattggtcatggcttggaggaccataatggctgtgttgtttgtggtcacactcattcctttatgcaggacaagctgtcttcaaaagcagtcacattgggtagaaataacagcactcatcctgggagcccaggctctgccagtgtacctaatgactctcatgaaaggagcttcaaagagatcttggccccttaacgagggtataatggctgtgggtttggtcagtctcttgggaagcgccctcctaaagaatgatgtccctttagctggcccaatggtggcaggaggcttacttctggcagcctatgtgatgagtggtagctcagcagacctgtcactagagaaggccgccaatgtgcagtgggatgagatggcagacataacaggctcaagcccaatcatagaagtgaagcaggatgaagatggctctttctccatacgggacatcgaggaaaccaatatgataaccctcttagtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgaaggagtgtacaggatcatgcaaagagggttgtttgggaaaactcaggttggagtagggatacacatggaaggtgtatttcacacaatgtggcatgtaacaagaggatcagtgatctgccatgagactgggagactggagccatcttgggctgacgtcaggaacgacatgatatcatacggtgggggatggaggctcggagacaaatgggacaaagaagaagatgttcaggttctagctatagaaccaggaaaaaatccgaaacatgtccaaacgaagcccggccttttcaaaaccctaactggagaaattggagcagtgacattggacttcaaacccggaacatctggttctcccatcattaacaggaaaggaaaagttatcggactctacggaaatggagtagtcactaaatcaggtgattacgtcagtgctataacgcaagccgaaagaactggtgagccagattatgaagtggatgaggacatttttcgaaagaaaagattaactataatggacttacaccccggagccggaaagacaaaaagaattctcccatcaatagtcagagaagccttaaaaaggaggctgcgaaccttgattttggctcccacgagagtggtggcggccgagatggaagaggccctacgtggactgccaatccgttatcagaccccagctgtgaaatcagaacacacaggaagagagatcgtagacctcatgtgtcatgcaaccttcacaacaagacttttatcatcaaccagggttccaaattacaacctcatagtgatggatgaagcacatttcacagacccttctagtgtcgcggctagaggatacatctcaaccagggtggaaatgggagaggcagcagccatctttatgactgcaacccctcctggagcgacagatcccttcccccagagcaacagcccaatagaagacatcgagagagaaattccagaaaggtcatggaacacagggttcgactggataaccgactaccaagggaaaactgtgtggtttgttcccagcataaaagctggaaatgacattgcaaattgcttgagaaagtcgggaaagaaggtgatccaattgagtagaaaaacctttgacacagagtatccaaaaacgaaacttacggactgggattttgtggttaccacagacatatcagaaatgggggccaattttagagctgggagagtgatagaccccaggagatgcctcaagccagttatctcaactgacgggccagagagagttattttggcaggtcccattccagtgactccagcaagcgctgctcagagaagagggcgaataggtaggaacccagcacaagaagatgaccaatatgtcttctccggagacccactaaaaaatgatgaagatcatgcccactggacagaagcaaagatgctgcttgataatatctacaccccggaagggatcattccaacattgtttggtccggaaagagaaaaaaatcaagccattgatggagagttccgcctcagaggggaacaaaggaagacttttgtagaattaatgaggagaggagaccttccggtgtggctgagctacaaggtagcttctgctggtatctcttacaaagaccgggaatggtgcttcacaggggaaaggaataaccaaattctagaagaaaacatggaggttgaaatttggactagagagggagagaagaaaaaactcaggccaaaatggttagatgcacgtgtttacgctgaccccatggctttgaaggatttcaaggagtttgccagtggaagaaagagcataaccctcgacatcctaacagagattgccagtttgccaacttacctttcctctagggctaagctcgcccttgacaacatagtcatgctccacacaacagaaagaggagggaaggcctaccaacatgccctgaacgaactcccggagtcactagaaacactcatgcttgtagctttactgggtgctatgacagcaggcatcttcttgtttttcatgcaaggaaaaggaatagggaaactgtcaatgggtttgatagccattgcggtagctagtggcttgctctgggtagcagaaatccagccccagtggatagcggcctcaatcatactagagttctttctcatggtgttgttgataccagaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggatttgagaccagcctcagcatggacgctctatgcagtagccaccactattctgactcccatgctgagacacaccatagaaaacacgtctgcaaacctatctctagcggccattgctaaccaagcagctgtcctaatggggcttggaaaaggatggccgctccacagaatggacctcggtgtgccgctgttggcaatgggatgctattctcaagtgaacccaacgaccttgatagcatccttagtcatgcttttagtccattacgcaataataggtccaggactgcaggcaaaagccacaagagaggctcagaaaaggacagcagctgggatcatgaagaaccccactgtggacgggataacagtaatagatctagaaccaatatcctatgacccaaaatttgaaaagcaattagggcaagtcatgctactagtcttgtgtgctggacagctactcttgatgagaacaacatgggctttctgtgaagtcttgactttggccacaggaccagtcttgaccctgtgggagggcaacccgggaaggttttggaacacgactatagccgtgtccactgccaatattttcaggggaagctacttggcgggagctggactggccttttcgctcataaagaatgcacaaacccccaggaggggaactgggaccacaggagagacactgggagagaagtggaagagacagctaaactcactagataggaaggagtttgaagagtacaaaagaagtggaatactagaagtggacaggactgaagccaagtctgccttgaaagatggatctaaaatcaagcatgcagtgtccagagggtccagcaagattagatggattgttgaaagagggatggtaaaaccaaaagggaaagttgtggatcttggttgcgggagaggaggatggtcgtactacatggcgacactcaagaacgtgaccgaggtgaaagggtacacaaaaggaggtccaggacatgaagaaccgattcccatggctacctatggctggaacttggtcaaactccattcaggggttgacgtgttctacaaacccactgagcaagtggataccctgctctgtgatattggggagtcatcttctaatccgacgatagaggaaggaagaacattaagagttttgaagatggtggaaccatggctctcttcaaaacctgaattctgcatcaaagtccttaatccctacatgccaacagtcatagaagagctggagaaactgcagagaaaacatggtggaagtcttgtcagatgcccgctatctaggaattccactcacgagatgtattgggtgtcaggtgtgtcgggaaacatcgtgagctctgtaaacacaacatcaaagatgttgttgaacagatttaccacaaggcatagaaaacccacttatgagaaggacgtagaccttggagcaggaacgagaagtgtctccactgaaacagaaaaaccggacatgacaatcattgggagaaggcttcagcgactgcaagaagagcacaaagaaacttggcactatgatcaggaaaacccatacagaacctgggcgtatcatggaagctatgaagctccttcgacaggctcagcatcctccatggtgaacggggtagtaaaattgctgacaaaaccctgggacgtgattccaatggtgacccagttggctatgacagacacaaccccttttgggcaacagagagtgtttaaagagaaggtggacaccagaacaccacaaccaaaacccggcacacgaatggttatgaccacgacagccaactggctgtgggctctcctcgggaagaagaaaaatcccagactgtgcacaagggaagagttcatctcaaaagttaggtcaaacgcagccataggcgcagtctttcaggaagaacagggatggacatcagccagtgaagctgtgaatgacagccgattttgggaactggttgacaaagaaagggctctgcaccaggaagggaaatgtgaatcgtgtgtctacaacatgatgggaaaacgtgagaaaaagttaggagagtttggtagagccaagggaagccgagcaatctggtacatgtggctgggagcgcggtttctggaatttgaagccctgggttttttgaatgaagatcactggtttggcagagaaaactcatggagtggagtggaaggggaaggtctgcatagattgggatatatcctggaggacatagacaagaaggatggagacctgatatatgctgatgacacagctggttgggacacaagaatcactgaagatgaccttctaaatgaagaactgatcacggaacagatggcccctcaccataagatcctagccaaagccattttcaaactaacttatcaaaacaaagtggtgaaagtcctcagacccacaccgaaaggagcggtgatggatatcatatccaggaaagaccaaagaggtagtggacaggttggaacatatggtttgaacacattcaccaacatggaagtacaactcatccgccaaatggaagctgaaggagtcatcacacaagatgacatgcataacccaaaagggttgaaagaaagagttgagaaatggctgaaagagtgtggtgtcgacaggttaaagaggatggcaatcagtggagacgattgtgtggtgaagcctctggatgagaggttcagcacttccctcctctttttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcaaggggctggatggagtttaagagaaacagcctgcctgggcaaagcttacgcccagatgtggtcgctcatgtactttcatagaagggacctgcgtttagcctccatggcgatatgctcagcagttccaacagaatggtttccaacaagcagaacaacatggtcaatccacgcccatcatcagtggatgaccactgaagatatgctcaaagtgtggaacagagtgtggatagaagacaaccctaatatgactgacaagactccagttcattcgtgggaagacataccttacctaggaaaaagagaagatttgtggtgtggatccttgattggactttcttccagggccacctgggcgaagaacattcacacagccataacccaggtcaggaacctgatcgggaaagaggagtatgtggattacatgccagtcatgaaaagatacagcgctcctttcgagagtgaaggagttctgtaa

SEQ ID NO: 1631 - DNA, 10164 bp, Dengue virus; identical to SEQ ID NO: 1626

SEQ ID NO: 1632 - DNA, 10164 bp, Dengue virus
atgaaccaacggaaaaaggtggttagaccgcctttcaatatgctgaaacgcgagagaaaccgcgtatcaaccccccaagggttggtgaagagattctcaatcggactgttttccgggaaaggacccttacggatggtgctagcattcatcacgtttctgcgagtcctttccatcccaccaacagcagggattctgaaaagatggggacagttgaagaaaaccaaggccatcaagatactgactggatttaggaaggagataggtcgcatgctgaacatcttgaacgggaggaagaggtcaacagtaacattactatgcttgattcccaccgtaatggcattccacttgtcaacaagagatggtgaaccccttatgatagtagcaaaacacgaaagggggaggcctctcttgtttaagacaacagagggaatcaacaaatgcactcttattgccatggatttgggtgaaatgtgtgaagacaccgtcacgtacaaatgccctttgctggtcaacaccgaacctgaagacattgactgctggtgcaatcttacgtctacctgggtcatgtatgggacatgtacccagaacggagaacggaggcgagagaagcgctcagtagctttaacaccacactcaggaatgggattggaaacaagggctgagacatggatgtcatcggaaggggcttggaaacatgcccagagagtggagagctggatactcagaaacccaggattcgcgctcttagcaggattcatggcctatatgatcgggcaaacaggaatccagcgaactgtcttctttgttctgatgatgctcgttgctccatcctacggaatgcggtgcataggagtggggaacagggattttgtggaaggggtctcaggtggagcatgggtcgatctggtgctagaacacggaggatgtgtcacaaccatggctcagggaaaaccaaccttggattttgaattgatcaagacaacagccaaggaagtggctctgttaagaacttattgcattgaagcctcgatatcaaacataaccacggcaacaagatgtccaacgcaaggagaaccttatctcaaagaggagcaagaccaacagtacatttgccggagagatgtggttgacagagggtggggcaatggctgtggcctgtttggaaaaggaggagttgtgacatgtgcaaagttctcatgctcagggaagataacaggcaacttggttcaaattgaaaaccttgaatacacggtggttgtgacagtccacaacggagacacccacgcagtaggaaatgacacatctaaccatggagtgacagccacgataactcctaggtcaccatcagtggaagttgaattaccggactatggagagctatcacttgattgtgaacccaggtctgggattgactttaatgagatgattctgatgaagatggaaaagaagacgtggcttgtgcacaagcaatggtttttggacttgcctctgccatggacggcaggagcagatacatcagaagtccactggaatcataaagagagaatggtgacattcaaggttcctcatgccaagagacaggatgtgacagtattaggatctcaggaaggagccatgcactctgccctcaccggagccacagaagtggattcaggtgatggaaatcacatgttcgcaggacatttaaagtgcaaagtacgcatggagaaattgagaattaagggaatgtcatacacgatgtgctcaggaaaattctcaattgatagggagatggcagaaacacagcatggaacaacggtagtgaaagttaagtatgaaggtactggagctccatgcaaagtccccatagagataagggatgtgaacaaagaaaaagtggttgggcgcatcatttcatctactccatttgctgagaataccaacagtgtaaccaatatcgaattagaacccccttttggagatagctacatagtgataggtgttggagacagtgcactaacactccattggtttaggaaagggagttccattggcaagatgtttgagtccacatacagaggcgcaaagcggatggccattctaggtgaaacagcttgggactttggttctgttggtggactgttcacatcactgggaaaagccgtgcaccaggtgtttggtagtgtctacacaaccatgtttggaggagtctcatggatggttagaatcctaatcgggctcctggtgctgtggatcggcacgaactcaagaaacactccaatggcgatgacgtgcatagctgttggaggaattactctgtttctgggtttcacggttcaggcagacatgggttgtgtagtgtcatggaccgggaaagaactaaaatgtggaagtggaatttttgtgactgacaacgtgcacacttggacagagcagtaccaatttcaaccagagtccccagcgagactagcgtccgcaatattgaacgcccacaaagatggggtctgtggaatcagatcaaccactaggctggaaaatgttatgtggaaacaaataactaacgagctaaattatgttctctgggaaggaggacatgacctcactgtggtggccggggatgtgaagggggtgctggttaaaggaaagagagcactcacacctccagtaaatgatttgaaatattcatggaagacatgggggaaagcaaaaatctttactccagaagcaaaaaatagcactttcttgatagacggaccagacacttccgaatgccccaatgaacggagagcatggaactttcttgaggtagaggactatggatttggcatgttcacgaccagcatatggatgaaattccgagaaggaagctcagaagtgtgtgatcacaggttaatgtcagcggcgatcaaagatcagaaagccgtgcatgctgacatgggctattggctagagagctcaaaaaaccagacctggcagatagagaaagcatcccttattgaggtgaaaacttgtctgtggcccaagactcacacgttatggagtaatggagtgttggaaagccagatgctcatcccaaaagcatatgcaggccccttttcacagcacaattatcgccagggctatgccacgcaaaccatgggcccatggcacctaggaaaattggaaatagactttggagaatgccccggaacaacagtcacaattcaggaggattgtgatcacagaggcccatctttgaggaccaccactgcatcaggaaaattggtcacacagtggtgctgccgctcctgcacgatgcctcctttaaggtttttgggagaggatgggtgttggtatgggatggaaattaggcctttaagtgaaagagaagagaacatggtcaaatcacaagtgtcggccggacagggttcatcagaaaccttttccatggggctgttatgtctgaccctgttcatagaagaatgcttgagaagaaaagttactaggaaacacatgatattggtcgtggtgaccaccttttgtgccatcatcctaggaggtctcacgtggatggacttactacgagccattatcatgctaggggacaccatgcttagtagggtgggaggacagactcatctagctatcatgatagtgttcaagatgtcaccaggatacgtgttgggtgtgttcctaaggaaactcacctcaagagaaacagcactaatggtgataggaatggccatgacaacggtgttttcaattccacatgaccttatggaacttattgatggaatatcattggggctgatcttactgaaaatggtaacacattttgacaacacccaagtgggaactttagccctttccttaactttcataagatcgacaatgccattgaccatggcttggagaaccatcatggctgtgttgtttgcggtcacactcattcctttatgtaggacaagctgcctgcaaaaacaatctcactgggtagagataacagcaatcatcttaggagcccaggctctgccagtctacttaatgaccctcatgaaaggagcctcaaaaagatcttggcctcttaacgagggcataatggctgtgggcttggtcagtctcttaggaagtgcccttctgaagaatgatgtccctttggctggtccaatggtggcaggaggtttacttctggcagcctacgtgatgagtggtagctcagcagacctgtctctagagagggccgccaatgtgcagtgggatgagatggcagacataacaggctcaagcccaattatagaagtgaagcaggatgaagatggctctttctccatacgggacgtcgaggaaaccaacatgataacccttttggtgaaactggcactgataaccgtgtcaggtctttaccccctggcaattccaatcacaatgactctatggtatatgtggcaagtgagaacacaacgatcaggagccctgtgggacgttccctcacccgccaccgctcagaaagccacactgactgaaggagtgtacagaatcatgcaaagagggttgttagggagaacacaggttggagtggggatacatatggaaggtgtatttcacacaatgtggcatgtaacaagaggatcagtgatctgccatgagactgggagattggagccatcttgggctgacgtcaggaacgacatgatatcatatggtggagggtggaggcttggggacaagtgggacaaagaagaagacgttcaggtcttagccatagaaccagggaaaaatccgaagcatgtccaaacgaaacccggccttttcaagaccttaactggagaaattggagcagtaacattggatttcaaacccggaacatctggctcacccatcattaacaagaaaggaaaagttatcggactctatggaaatggagtagttaccaaatcaggtgattatgtcagcgccataacgcaagccgagagaattggtgagccagattatgaggtggatgaggacatctttcgaaagaaaagattaaccataatggacttacaccccggggctggcaagacaaaaagaattctcccttccatagtcagagaagctctaaaaaggaggttacgaaccctgattttggctcctacgagagtggtggcagccgagatggaagaagccctccgcggactaccaatccgttatcaaactccagctgtgaagtcagaacacacaggaagagagatcgtagacctcatgtgtcatgcaaccttcacaacaagactcttgtcatcaaccagagtaccaaattacaatctcatagtaatggatgaagcgcacttcacagacccttctagtgttgcagctagaggatacatctcaaccagggtggaaatgggagaggcagcagccatcttcatgactgcaacccctcccggggcaacagatccattcccccaaagcaacagccccatagaagacattgagagagaaattccagaaaggtcatggaacacaggatttgactggataacagactaccaagggaagactgtgtggtttgttcccagtataaaagctggaaatgacattgcaaattgcctgagaaaatcgggaaagaaggtgatccaattgagtaggaagacctttgatactgagtacccaaaaacgaaactcacagactgggattttgtggtcaccacagacatatctgagatgggggccaatttcagagccgggagagtgatagaccccaggagatgcctcaagccagtcatcctaacagatgggccagagagagtcattttggcaggtcccattccagtgactccagcaagcgctgctcaaagaagagggcgaataggcagaaatccagcacaagaagacgatcagtatgtcttctctggagatccattgaaaaacgacgaagatcacgcccactggacagaagcaaaaatgctgcttgacaatatctacaccccggaagggatcattccaacattgtttggcccggaaagggaaaaaacccaagccattgacggagagtttcgcctcagaggagaacaaaggaagacttttgtggaattaatgaagagaggagaccttccggtgtggctgagctataaggtagcttcagctgggatttcatataaagatcgggaatggtgcttcacaggggaaagaaataatcaaatcttagaagaaaacatggaggttgaaatttggactagagagggagaaaagaaaaaactaagaccaaaatggttagatgcacgtgtctatgctgaccccatggctttgaaggacttcaaggaatttgctagtggaagaaagagcataacccttgatatcctgacagagatcgccagcctgccaacttacctctcttctagagccaagctcgcccttgacaatatagtcatgctccacacaacagaaaggggagggagggcctatcaacacgccctgaacgaactcccggagtcattggaaacactcatgcttgtagctttattaggtgctatgacagcaggcatatttctgttttttatgcaaggaaaagggatagggaaactgtcagtgggcctgatagctattgcggtagctagtggcttactctgggtagcagaaattcagccccagtggatagcggcctcaatcatactggagttctttctcatggtgttgttgatcccagaaccagaaaaacagaggaccccacaagacaaccagttgatttatgtcatactggctattctcactattattggtctcgtagcagccaacgagatggggctgattgagaaaacaaaagcggattttgggttttaccaagtaaaaacagaaaccacaatcctcgatgtggatttgagaccagcttcagcatggacgctctacgctgtagccaccaccattctgactcccatgctaagacacaccatagaaaatacatctgccaacctatctctggcggctatagctaatcaagcagctgtcctaatggggcttggaaaaggatggccactccacagaatggaccttggtgtgccgctattagcaatgggatgttattctcaagtgaacccaacaaccttgacagcgtccttggtcatgctcttggtccattatgcaataataggtccaggattacaggcaaaagctacaagagaagctcagaaaaggacagctgctgggatcatgaagaaccccacggtggatggaataacagtaatagatctagaaccaatatcttatgacccaaagtttgaaaagcagttagggcaggttatgttgctggtcttgtgtgctggacaactactcttgatgagaacaacatgggctttctgtgaagtcttaactttggccacaggaccagtcttaactttgtgggagggcaacccgggaagattttggaacacgaccatagccgtgtccactgccaacattttcaggggaagctacttggcgggagctggactggctttctcactcataaagaatgcacagacccccaggaggggaactggaaccacaggagagacactgggagagaaatggaagagacaactaaactcattagataggaaggagtttgaagagtacaagagaagtggaatattggaggtggacaggactgaagccaagtccgccctgaaagatgggtctaaaatcaagcacgcagtgtccagagggtcaagcaagatcagatggattgttgaaagagggatggtaaagccaaaagggaaagttgtggatcttggttgcgggagaggaggatggtcgtattacatggcgacgctcaagaacgtgactgaggtgaaagggtacacgaaaggaggtccaggacatgaagaacccattcccatggctacctatggctggaatttggtcaagctccattcaggagtagacgtgttctacaaacccactgagcaagtggacaccctgctctgtgatattggagagtcatcttctaatccgacaatagaggaaggaagaacattaagagttctgaagatggtggagccatggctctcttcgaagcctgaattctgcatcaaggtcctcaatccctacatgccaacagttatagaagaactggagaaactgcagagaaagcatggtggaagtctcatcagatgcccgctatccagaaattccacccatgagatgtattgggtgtcaggtgcgtcgggaaacattgtgagctctgtgaatacaacatcaaaaatgctgttgaataggtttactacgaggcataggaaacccacctatgagaaggatgtagaccttggagctggaacaagaagtgtctccactgaaacagagaaaccagacatgacaatcattgggagaagacttcagcgattgcaagaagagcacaaagaaacttggcactatgatcaggaaaatccatacagaacttgggcgtatcatggaagctatgaagctccttcgacaggctcagcatcctccatggtaaacggggtagtaaaactgctgacaaaaccttgggacgtgattccgatggtgacccagttagccatgacagatacaaccccctttggccaacaaagagtgtttaaagagaaggtggacaccagaacaccacagccaaaactaggcacacgagtggttatgaccacaacagccaattggctgtgggccctccttgggaggaagaaaaatcccagattgtgtacgagggaagagttcatctcaaaagttaggtcaaacgcagccataggtgcggtcttccaggaagaacagggatggacatcagccagtgaagctgtgaatgacagccggttttgggaactggttgacaaagaaagggctctgcaccaagaagggaaatgtgaatcgtgcgtctacaacatgatggggaaacgtgagaaaaaactgggagagttcggtagagccaaaggaagccgagcaatctggtacatgtggttgggggcgcggtttctagaatttgaagccctgggtttcctaaatgaagatcactggtttggtagagaaaattcatggagtggagtggaaggagagggtctgcacagactgggatacatcttagaagacatagataggaaggacggggacttgatgtatgctgatgacacggcaggttgggacacaagaatcactgaagatgaccttctaaatgaagaactaatcacagaacagatggctcctcaccacaggatcttagccaaagccattttcaaactgacttaccaaaataaagtggtaaaagttctcagacccacaccgaaaggagcggtcatggacatcatatccaggaaagaccaaagaggtagtggacaggttggaacatacggtttaaacacattcaccaacatggaagtacaacttatccgccaaatggaagctgaaggagttatcacacaagatgacatgcaaaacccaaaagggctgaaagaaagagttgagaaatggctgaaagagtgtggtgtcgacaggttgaaaagaatggcaatcagtggagatgattgtgtggtaaaacccctggatgagaggttcagtacttccctcctcttcttgaatgacatgggaaaagtaaggaaagacattccacagtgggaaccatccaagggatggaagaattggcaagaggtccctttctgctcccaccactttcacaagatcttcatgaaggatggccgatcactggttgttccatgtagaaaccaggatgaactgatagggagagccagaatctcgcagggggctggatggagcttgaaagaaacagcctgtttgggcaaagcttacgcccagatgtggtcactcatgtattttcacagaagggacctgcgtttagcctccatggctatatgctcagcagttccaacagaatggtttccaacaagcagaacaacatggtcaatccacgcccaccatcaatggatgactactgaagacatgctcaaagtgtggaacagagtatggattgaagacaaccctaacatgactgacaaaactccagtccactcgtgggaagacataccttacctagggaaaagagaggacttgtggtgtggatcgttgattgggctttcttccagagctacctgggcgaaaaacattcatacagccataacccaagtcaggaacctgatcgggaaagaggagtatgtggactacatgccagtcatgagaagatacagcgccctttccgagagtgaaggagttctgtaa

SEQ ID NO: 1633 - DNA, 10164 bp, Dengue virus
atgaaccaacgaaaaaaggtggttagaccacctttcaatatgctgaaacgcgagagaaaccgcgtatcaaccccccaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggaccaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcctggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgaaaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacctaggtctggaattgactttaatgagatgatcctaatgaaaatgaaaaagaaaacatggctcgtgcataagcaatggtttttggatctgcctcttccatggacagcaggagcagacacatcagaggttcattggaattacaaagagagaatggtgacatttaaggttcctcatgctaagagacaggatgtgacagtgctaggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggcgctggagctccgtgcaaagtccccatagagataagagatgtaaacaaggaaaaagtggttgggcgcgttatctcatccacccctctggctgagaataccaacagtgtaaccaacatagaattagaacccccctttggggacagctacatagtgataggtgttggaaacagcgcattaacactccattggtttaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaatcgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggatagaacagtacaaattccaaccagagtccccagcgagactagcgtccgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagaacactcacacccccggtgagtgatctgaaatattcatggaagacatggggaaaagcaaaaatcttcacccctgaagcaagaaacagcacatttttaatagatggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacttggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcggaaactttttctatgggtctgttgtgcctgaccttgtttgtggaagaatgcctgaggagaagggtcactaggaaacacatgatattagctgtggtaatcactctttgtgctatcatcctggggggcctcacatggatggacttgttacgagccctaatcatgttgggggacactatgtctggtagaataggaggacagacccacctagccatcatggcagtgttcaagatgtcaccaggatatgtgctgggtgtgtttttaaggagactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcgttggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctgtagaaccaggaaaaaatcccaaacatgtccaaacgaaacctggccttttcaagaccataactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaaggttgactataatggacttacaccccggagctggaaagacaaaaagaattcttccatcaatagtgagagaagccctaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttctgtcatcaaccagggttccaaattacaaccttatagtaatggatgaagcacatttcaccgatccttccagtgtcgcggctagaggatacatttcgaccagggtagaaatgggagaggcagcagccatcttcatgaccgcaacccctcccggagcgacagatccctttccccagagtaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacagactgggactttgtggtcactacagatatatctgaaatgggggctaattttagagctgggagagtgatagaccctagaagatgcctcaagccagttatcctaacagatgggccagagagagttattttagcaggtcctattccagtgactccagcaagcgctgctcagagaagagggcgaatagggaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttggatgcacgtgtatacgctgaccccatggctttgaaggatttcaaggagtttgccagtggaaggaagagtataactctcgacatcctaacagagattgccagtttgccaacttacctctcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgacgtggacttgagaccagcttcagcatggacgctctatgcggtagccaccacaattctaactcccatgctgagacacaccatagaaaacacgtcggccaacctatctctagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaattatgaaaaatcccacagtggacgggataacagtaatagatctagaaccaatatcctatgacccaaaatttgaaaagcaattagggcaggtcatgctactagttttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagaggcatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatccaagatgttgttgaacaggtttacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaagccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagacgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctaggcaaagcttacgcccagatgtggtcgcttatgtacttccacagaagggatctgcgtttagcctctatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcatgggaagatataccttatctagggaaaagagaggatttgtggtgtggatccctgattggactttcttctagagccacctgggcgaagaacattcacacggccattactcaggtcaggaacctgatcggaaaagaggaatacgtggattacatgccagtaatgaaaagatacagtgctccttcagagagtgaaggagttctgtaa

SEQ ID NO: 1634 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttccgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgtactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatacttagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactactgcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagagattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaagggggtgttgaccaagggcaagagagcactcacacccccagcgagtgatctgaaatattcatggaagacatggggaaaagcaaaaatcttcacccctgaagcaagaaacagcacatttttaatagacggaccagacacctctgaatgccccaatgaacgaagagcatggaattcatttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgctacgcaaaccgtgggtccatggcacttaggcaaactagagatagactttggagaatgccccggaacaacagtcacaattcaggaggattgtgatcatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggttaaatcacaggtgacggccggacagggcacatcggaaactttttctatgggcctgttatgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgtttaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccagtcacaatgaccttatggtacatgtggcaagtgaaaacacaaagatcaggagccctgtgggacgtcccttcacccgctaccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaactcctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctgacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaattatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggaaaaaacagaaaccaccatcctcgatgtggacttgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggtaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggacgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagaatttggcagagccaagggaagccgagcaatctggtacatgtggctgggagcgcggtttctggaatttgaagccctgggttttttgaatgaagatcactggtttggcagagaaaattcatggagtggagtggaaggggaaggtttgcacagattgggatacatcctggaggagatagacaagaaggatggagacctaatgtatgctgatgacacagcaggctgggacacaagaatcactgaggatgaccttcaaaatgaggaattgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggcttgaacacattcaccaacatggaagttcaactcatccgccagatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatatcccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 1635 - DNA, 10164 bp, Dengue virus
atgaaccaacgaaaaaaggtggttagaccacctttcaatatgctgaaacgcgagagaaaccgcgtatcaaccccccaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgaaaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacctaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgcaaagtccccatagagataagagatgtaaacaaggaaaaagtggttgggcgcgttatctcatccacccctctggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaatcgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtccgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccggtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacttggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggtccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcctgaggagaagagtcactaggaaacacatgatattagctgtggtaatcactctttgtgctatcatcctggggggcctcacatggatggacttgctacgagccctaatcatgttgggggacactatgtctggtagaataggaggacagacccacctagccatcatggcagtgttcaagatgtcaccaggatacgtgctgggtgtgtttttaaggagactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctgtagaaccaggaaaaaatcccaaacatgtccaaacgaaacctggccttttcaagaccataactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattgactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagtaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagatatatctgaaatgggggctaattttagagctgggagagtgatagaccctagaagatgcctcaagccagttatcctaacagatgggccagagagagttattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttggatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagaggcatggtaaagccaaaagggaaagttgtagatcttggctgtgggagaggaggatggtcttattacatggcgacactcaagaacgtgactgaagtgaaagggtatacaaaaggaggcccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggtttacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctaggcaaagcttacgcccagatgtggtcgcttatgtacttccacagaagggatctgcgtttagcctctatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 1636 - DNA, 10164 bp, Dengue virus
atgaaccaacgaaaaaaggtggttagaccacctttcaatatgctgaaacgcgagagaaaccgcgtatcaacccctcaggggttggtgaagagattctcaaccggacttttttctgggaaagggcccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagtgttgtggattggtacgaactcaaggaacacttcaatggccatgacatgcatagctgttggaggaatcactctgtttttgggcttcacagtccaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcagataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggatactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctagctggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaaattgtagatcttggctgtggaagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggcttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1637 - DNA, 10164 bp, Dengue virus
atgaaccaacgaaaaaaggtggttagaccacctttcaatatgctgaaacgcgagagaaaccgcgtatcaacccctcaggggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgatgacattgttgtgcttgattcccaccgcaatggcgtttcacttgtcaacaagagatggcgaacccctcatgatagtggcaaaacatgaaagagggagacctctcttgtttaagacaacagaagggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatggttgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtacacaaccatgtttggaggagtctcatggatgattagaatcctaattgggttcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatactcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtctgcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctagtgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1638 - DNA, 10164 bp, Dengue virus
atgaaccaacgaaaaaaggtggttagaccacctttcaatatgctgaaacgcgagagaaaccgcgtatcaacccctcaggggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtaacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtctccaaaaacagtctcattgggtagaaataacagcacttatcctaggagcccaagctctgccagtgtacctaatgactcttatgaaaggagcctcaagaagatcttggcctcttaacgagggcataatggctgtgggtttggttagtctcttaggaagcgctcttttaaaaaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgacacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacacgaagaaccgattcccatggctacttatggctggaatttggtcaaactccattcaggagttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1639 - DNA, 10164 bp, Dengue virus
atgaaccaacgaaaaaaggtggttagaccacctttcaatatgctgaaacgcgagagaaaccgcgtatcaacccctcaggggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaagaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggctcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccatttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaacaaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggactttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaagcaaaagccacaagggaggcccagaaaaggacagctgctggaattatgaaaaatcctacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggaaggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggcctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttgccacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1640 - DNA, 10164 bp, Dengue virus
atgaaccaacgaaaaaaggtggttagaccacctttcaatatgctgaaacgcgagagaaaccgcgtatcaacccctcaggggttggtgaagagattctcaaccggacttttttctgggaaaggacccttacggatggtgctagcattcatcacgttcttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggcgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaactccacattcaggaatgggattggaaacaagagctgagacatggatgtcatcggaaggggcttggaagcatgctcagagagtagagagctggatactcagaaacccaggatttgcgctcctggcaggattcatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggagggtgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaagaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtccaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgctcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggtagggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggctcttagtgttgtggattggtacgaactcaaggaacacttcaatggccatgacatgcatagctgttggaggaatcactctgtttctgggcttcacagttcaagcggacgtgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgaactaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttgatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgtacaggtcctcgctatagaaccaggaaaaaatcccaaacatgtccaaacgaaacctggccttttcaaaaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccctaaaaaggaggctgcgaactttgattttggctcccacaagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccatttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtagaaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtaactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaacaaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagcttgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaagcaaaagccacaagggaggcccagaaaaggacagctgctggaattatgaaaaatcctacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggaaggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcattaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaatcaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggcctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttgccacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagaatgaaggagttctgtaa

SEQ ID NO: 1641 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatgggggcagttgaagaaaaataaggccatcaagatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctagtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggggagccctatctgaaagaggaacaggaccaacagtacatttgccggagagatgtggtagacagagggtggggcaatggttgtggcttgtttggaaaaggaggagttgtgacatgtgcgaagttttcatgttcggggaagataacaggcaatctggtccaaattgagaaccttgagtatacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggaaaaattgagaatcaagggaatgtcatacacgatgtgctcaggaaagttctcaatcgacaaagagatggcagaaacacagcatgggacaacagtggtgaaagtcaagtatgaaggtgctggagctccgtgtaaagtccccatagagataagagatgtaaacaaggaaaaagtggttgggcgcgtcatctcatccacccctttggctgagaataccaacagtgtaaccaacatagaattagaacccccctttggggacagctacatagtgataggtgttggaaacagcgcattaacactccattggttcaggagagggagttccattggcaagatgtttgagtccacatacagaggtgcaaaacgaatggccattctaggtgaaacagcttgggattttggttccgttggtggactgttcacatcattgggaaaggctgtgcaccaggtttttggaagcgtgtatacaaccatgtttggaggagtctcatggatgattagaatcctaattgggttcttagtgttgtggattggcacaaactcaaggaacacttcaatggctatgacgtgcataactgttggaggtatcactctgtttctgggcttcacagttcaagcggacatgggttgtgtggtatcatggagtgggagagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgccctctgggaaggaggacacgatctcactgtagtggctggggatgtgaagggggtgttgaccaaaggcaagagagcactcacacccccagtgagtgatctgaaatattcatggaagacatggggaaaagcaaaaatcttcaccccagaagcaagaaacagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaatcagacctggcagatagagaaagcatctcttattgaagtgaaaacatgtctgtggcccaagacccacacactgtggagcaatggagtactggaaagccagatgctcattccaaaatcatatgcgggccctttttcacagcacaattaccgccagggctatgccacgcaaaccgtgggtccatggcacttaggcaaattagagatagacttcggagaatgccccggaacaacagtcacaattcaggaggattgtgaccatagaggcccatctttgaggaccaccactgcatctggaaaactagtcacgcagtggtgctgccgctcctgcacgatgcctcccttaaggttcttgggagaagatgggtgctggtatggaatggagattaggcccttgagtgaaaaagaagagaacatggtcaaatcacaggtgacggccggacagggcacatcagaaactttttctatgggactgttgtgcctgactttgtttgtggaagaatgcttgaggagaagagtcactaggaaacacatgatattagttgtggtaatcactctttgtgctatcatcctgggaggcctcacatggatggacttactacgagccctcatcatgttaggggacactatgtctggtagaataggaggacagatccacctagccatcatggcagtgttcaagatgtcaccaggatacgtgctgggtgtgtttttaaggaaactcacttcaagagagacagcactaatggtgataggaatggccatgacaacggtactttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtctccaaaaacagtctcattgggtagaaataacagcactcatcctaggagcccaagctctgccagtgtacctaatgactcttatgaaaggagcctcaagaagatcttggcctctcaacgagggcataatggctgtgggtttggttagtctcttaggaagcgcccttttaaaaaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaagatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggttctcgccatagaaccaggaaaaaatcctaaacatgtccaaacgaaacctggccttttcaagaccctaactggagaaattggagcagtaacattggatttcaaacccggaacgtctggttctcccatcatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccgaattacaaccttatagtgatggatgaagcacatttcaccgatccttctagtgttgcggctaggggatacatttcgaccagggtggaaatgggagaggcagcagccatcttcatgactgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctagaagatgcctcaagccagttatcctaacagatgggccagagagagtcattttagcaggtcctattccagtgactccagcaagtgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctacaaggtagcttctgctggcatatcttataaagatcgggagtggtgcttcacaggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctccagggccaagctcgcccttgataacatagtcatgctccacacaacagaaagaggagggagggcctatcaacacgccctgaacgaacttccagagtcactggaaacactcatgcttgtagctttactaggtgctatgacagcaggtatcttcctatttttcatgcaagggaaaggaatagggaaattgtcaatgggtttgatagccattgcggtggctagtggtttgctctgggtagcagaaattcaaccccagtggatagcggcctcaatcatactagagttttttctcatggtactgttgataccagaaccagaaaaacaaaggactccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgctagcaatgggatgctattcccaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggtaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtacaaaagaagtggaatactagaagtggacaggactgaagccaagtcagccctgaaagatgggtctaaaatcaagcatgcagtatctagagggtccagcaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccgggacatgaagagccaattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagtcttgaagatggtggagccatggctctcttcaaaacctgaattctgtatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacggaaaaaccagacatgacaatcattgggagaaggcttcagcgattgcaagaagagcacaaagaaacctggcattatgatcaggagaacccatacagaacctgggcgtatcatggaagctatgaagctccttcgacaggctctgcatcctccatggtgaacggggtagtgaaactgctaacaaaaccctgggatgtgattccaatggtgactcagttagccatgacagatacaaccccttttgggcaacaaagagtgttcaaagagaaggtggataccagaacaccacaaccaaaacccggcacacgaatggttatgaccacgacagccaattggctgtgggctctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgataaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggttatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaataaagtggtgaaagtcctcagacccacaccgagaggagcggtgatggatatcatatccaggaaagaccaaagaggcagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagtcgttccatgtagaaaccaggatgagctaatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagaccccagtccattcgtgggaagatataccttacctagggaaaagagaggatttgtggtgtggatccttgattggactttcttctagagccacctgggcgaagaacattcacacggccataacccaggtcaggaacctgatcggaaaagaggaatacgtagattacatgccagtaatgaaaagatacagtgctctttcagagagtgaaggagttctgtaa

SEQ ID NO: 1642 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaaaagatggggacagttgaagaaaaataaggccatcaggatactgattggattcaggaaggagataggccgcatgctgaacatcttgaacgggagaaaaaggtcaacgataacattgctgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccttactggtcaataccgaacctgaagacattgattgctggtgcaatctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagaacatggaggatgcgtcacaaccatggcccagggaaaaccaaccttggattttgaactgactaagacaacagccaaggaagtggctctgttaagaacctattgcattgaagcctcaatatcaaacataaccacggcaacaagatgtccaacgcaaggagagccttatctaaaagaggaacaagaccaacagtacatctgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgattctgatgaaaatgaaaaagaaaacatggcttgtgcataagcaatggtttttggatctacctctaccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttctcaattgacaaagagatggcagaaacacagcatgggacaacagtggtgaaagtcaagtatgaaggtgctggagctccgtgtaaagtccccatagagataagagatgtgaacaagaaaaaagtggttgggcgtatcatctcatccacccctttggctgagaataccaacagtgcaaccaacatagagttagaacccccctttggggacagctacatagtgataggtgttggaaacagtgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcctagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccggagtccccagcgagactagcgtctgcaatattgaatgcccacaaagatggggtctgtggaattagatcaaccacgaggctggaaaatgtcatgtggaagcaaataaccaacgagctaaattatgttctctgggaaggaggacatgacctcactgtagtggctggggatgtgaagggggtgttgaccaaaggcaagagagcactcacacccccagtgaatgatctgaaatattcatggaagacatggggaaaagcaaaaatcttcaccccagaagcaagaaatagcacatttttaatagacggaccagacacctccgaatgccccaatgaacgaagagcatggaactttcttgaggtggaagactatggatttggcatgttcacgaccaacatatggatgaaattccgagaaggaagttcagaagtgtgtgaccacaggttaatgtcagcggcaattaaagatcagaaagctgtgcatgctgacatgggttattggatagagagctcaaaaaaccagacctggcagatagagaaagcatctcttattgaagtgaaaacatgtctgtggcccaagacccacacattgtggagcaatggagtgctggaaagccagatgctcattccaaaatcatatgcgggccctttttcacaccacaattaccgccagggctatgccacgcaaaccgtgggcccatggcacttaggcaaattagagatagactttggagaatgccccggaacaacagtcgcaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtaacggccggacagggcacatcagaaactttttctatgggtctgttgtgcctgaccttgtttgtggaagaatgcttgaggagaagagtcactaggaaacacatgatattggttgtggtgatcactctttgtgccatcatcctaggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactggggctaattttgctaaaaatagtgacacattttgacaacacccaagtgggaaccttagccctttccttgaccttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaatgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttatttgggaaaactcaggttggagtagggatacacatggaaggtgtatttcacacaatgtggcatgtaacaagaggatcagtgatctgccatgagactgggagattggagccatcttgggctgacgtcaggaatgacatgatatcatacggtgggggatggagacttggagacaaatgggacaaagaagaagatgttcaggtcctcgccatagaaccaggaaaaaatcctaaacatgtccaaacgaaacccggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaaccttgattttggctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagagttccaaattacaacctcatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggattttgtggtcactacagacatatctgaaatgggggccaattttagagctgggagagtgatagaccctaggagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaaggaataaccaaattttagaagaaaacatggaggttgaaatttggactagagagggagaaaagaaaaagctaaggccaagatggttagatgcacgtgtatacgctgaccccatggctttgaaggattttaaggagtttgctagtggaaggaagagcataactctcgacatcctaacagagattgccagtttgccaacttacctttcctctagggccaagctcgcccttgataacatagtcatgctccacacaacagaaagaggagggagggcctaccaacacgccctgaacgaactcccggagtcactggaaacacttatgcttgtagctttactaggtgctatgacagcaggtatcttcctgtttttcatgcaagggaaaggaatagggaaattgtcaatgggtttgataaccattgcggtggctagtggcttgttctgggtagcagaaattcaaccccagtggatagcggcctcaatcatactagagttttttctcatggtactgttgataccggaaccagaaaaacaaaggaccccacaagacaatcaattgatctacgtcatattgaccattctcaccattattggtctcatagcagccaacgagatggggctgattgaaaaaacaaaaacggattttgggttttaccaggtaaaaacagaaaccaccatcctcgatgtggacttgagaccagcttcagcatggacgctctatgcagtagccaccacawttctgactcccatgctgagacacaccatagaaaacacgtcggccaacctatctctagcagccattgccaaccaggcggccgtcctaatggggcttggaaaaggatggccgctccacagaatggacctcggtgtgccgctgttagcaatgggatgctattctcaagtgaacccaacaactttgacagcatccttagtcatgctttcagtccattatgcaataataggtccaggattgcaggcaaaagccacaagagaggcccagaaaaggacagctgctgggatcatgaaaaaccccacggtggacgggataacagtaatagatctagaaccaatatcctatgacccaaaatttgaaaagcaattagggcaggtcatgctactcgtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacctggcgggagctggactggctttttcactcataaagaatgyacaaacccctaggaggggaactgggaccacaggagagacactgggagagaagtggaagagacagctaaactcattakacagaaaagagtttgaagagtataaaagaagtggaatactagaagtggacaggactgaagccaagtctgccctgaaagatgggtctaaaatcaagcatgcagtatctagagggtccagtaagattagatggattgttgagagagggatggtaaagccaaaagggaaagttgtagatcttggctgtgggagaggaggatggtcttattacatggcgacgctcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaattattgggagaaggcttcagcgattgcaagaggagcacaaagaaacctggcattatgatcaggaaaacccatacagaacctgggcgtatcatggaagctatgaagctccttcgacaggctctgcatcctccatggtgaacggggtagtaaaactgctaacaaaaccttgggatgtggttccaatggtgacccagttagccatgacagacacaaccccttttgggcaacaaagagtgttcaaagagaaggtggataccagaacaccacaaccaaaacccggtacacgaatggttatgaccacgacagccaattggctgtgggccctccttgggaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctacaacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaagaactgatcacggaacagatggccccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctggatgagaggtttggcacttccctcctcttcttgaacgacatgggaaaggtgaggaaagacattccgcagtgggaaccatctaagggatggaaaaactggcaagaggttcctttttgctcccaccactttcacaagatcttcatgaaggatggccgctcactagttgttccatgtagaaaccaggatgaactgatagggagagccagaatctcgcagggggctggatggagcttaagagaaacagcctgcctgggcaaagcttacgcccagatgtggtcgctcatgtacttccacagaagggatctgcgtttagcctccatggccatatgctcagcagttccaacggaatggtttccaacaagcagaacaacatggtcaatccacgctcatcatcagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcagaaacctgatcggaaaagaggaatacgtggattacatgccagtaatgaaaagatacagcgctccttcagagagtgaaggagttctgtaa

SEQ ID NO: 1643 - DNA, 10164 bp, Dengue virus; identical to SEQ ID NO: 1642

SEQ ID NO: 1644 - DNA, 10164 bp, Dengue virus; identical to SEQ ID NO: 1642

SEQ ID NO: 1645 - DNA, 10164 bp, Dengue virus
atgaaccaacgaaaaaaggtggttagaccacctttcaatatgctgaaacgcgagagaaaccgcgtatcaacccctcaggggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgatgacattgttgtgcttgattcccaccgcaatggcgtttcacttgtcaacaagagatggcgaacccctcatgatagtggcaaaacatgaaagagggagacctctcttgtttaagacaacagaggggatcaacaaatgcactctcattgccatggacttgggtgaaatgtgtgaggatactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcctggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggaccaacagtacatctgccggagggatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccgtcggtagaagtcaaattgccggactatggagaactaacactagattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacattcaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcatcaggtttttggaagtgtgtatacaaccatgtttggaggagtctcatggatgattagaatcctaattgggttcttagtgttgtggattggtacgaactcaaggaacacttcaatggccatgacatgcatagctgttggaggaatcactctgtttttgggcttcacagttcaagcggacatgggttgtgtggtgtcatggagtgggagagaattgaagtgtggaagcggaatttttgtagttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgttcctgcacaatgccccccttaaggttcttgggagaagatgggtgctggtatgggatggagattaggcccttgagtgaaaaagaagagaacatggttaaatcacaggtgacggccggacagggcacatcggaaactttttctatgggtctgttgtgcctaaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatatgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcgattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaaccgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattgatgaggagaggagaccttccagtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatattggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcctatgctgagacacaccatagaaaacacgtcggccaacctatctctggcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagggaggcccagaaaaggacagctgctggaattatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaacctcgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggcttcagcgattgcaagaagagcacaaagaaacatggcattatgatcaggagaatccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgttaatgacagtcggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctagaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaggtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaatccaaaagggttgaaagaaagagttgagaaatggctgagagagtgtggtgtcgacaggttaaaaaggatggcaatcagtggagacgattgcgtggtgaagcccctagatgagaggtttggcacttccctcctcttcctgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1646 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgttacgtataaatgccccctactgatcaataccgaacctgaagacattgattgctggtgcaacctcacgtctacctgggtcatgtatgggacatgtacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttcttcgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagccttaatatcaaacataactacggcaacaagatgtccaacgcaaggagagccttatctgaaagaggaacaggatcaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgactgtgaacccaggtctggaattgactttaatgagatgatcctaatgaaaatgaaaaagaaaacatggctcgtgcacaagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcacgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtgaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatactaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggtaagagagcactcacacccccagtgagtgatctgaaatattcatggaagacatggggaaaagcaaaaatcttcacccctgaagcaagaaatagcacatttttaatagacggaccagacacctctgaatgccccaatgaacgaagagcatggaattctcttgaggtggaagactatggatttggcatgttcactaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgcctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcgtctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcggaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacgacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcactgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgttatgagtggcagctcagcagatctgtcactagagaaggccgctagtgtgcaatgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatagaaggtgtatttcacacaatgtggcatgttacaagaggatcggtgatctgccacgagactgggagattggagccatcttgggctgacgtcaggaatgacatgatatcatacggtgggggatggaggcttggagacaaatgggacaaagaagaagacgtccaggtcctcgctatagaaccaggaaaaaatcccaaacatgtccaaacgaaacccggccttttcaagaccctaactggagaaattggagcagtaacattagatttcaaacccggaacgtctggttctcccattatcaacaggaaaggaaaagtcatcggactttatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccagaccccagctgtgaaatcagaacacacaggaagagagattgtagacctcatgtgccatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcctagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaattttagggctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacctttgtagaattaatgaggagaggagaccttccggtgtggctgagctataaggtagcttctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccactgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacagaactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccagggcatgaagaaccgattcccatggctacttatggctggaatttggtcaaactccattcaggggttgacgtgttctacaaacccatagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacctatgagaaggacgtagatcttggggcaggaacgagaagtgtctctactgaaacagaaaaaccagacatgacaatcattgggagaaggctccagcgattgcaagaagagcacaaagaaacatggcattatgaccaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaggaacagggatggacatcagccagtgaagctgtgaatgacagccggttctgggaactggttgacaaagaaagggcccttcaccaagaagggaaatgtgaatcgtgtgtctacaacatgatgggaaaacgtgagaaaaagttaggagagtttggcagagccaagggaagccgagcaatctggtacatgtggctgggagcgcgatttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctaggaaaaagagaggatttgtggtgcggatccctgattggactttcttctagagccacctgggcgaaaaacattcacacggccataactcaggtcaggaacctgatcggaaaagaggaatacgtggattacatgccagtaatgaaaagatacagtgctccttcagagagtgaaggagttctgtaa

SEQ ID NO: 1647 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagattttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtgacagtccacaatggagacacccatgcagtaggaaatgacacatccaatcatggagttacagccacgataactcccaggtcaccatcggttgaagtcaaactgccggactatggagaactaacactcgattgtgaacccaggtctggaattgacttcaatgagatgatcctaatgaaaatgaaaaagaaaacatggctcgtgcataagcaatggttcttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcgggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgctcacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagatacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctctcattgaagtaaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttgggcaaactagagatagactttggagaatgccccggaacaacagttacaattcaggagaattgtgaccatagaggcccatctttgaggaccaccactgcatctggaaaactagtcacgcaatggtgttgccgctcctgcacaatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcttaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtccgaaggagtgtacaggatcatgcaaagagggttattcgggaaaactcaggttggagtagggatacacatggaaggtgtatttcacacaatgtggcatgtcacaagaggatcggtgatctgccacgagactgggagattggagccatcttgggctgacgtcaggaatgacatgatatcatacggtgggggatggaggcttggagacaaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtggttaccaaatcaggtgactacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtagtggcggccgagatggaagaggccctacgtggactgccaatccgttaccaaaccccagctgtgaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgacagcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgcccagagaagagggcgaataggaaggaacccagcacaagaagacgaccaatacgttttctccggagacccactaaaaaatgatgaagatcatgcccactggacagaagcaaagatgctgcttgacaatatctacaccccagaaggaatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggcttgataaccattgcggtggctagtggcttgctctgggtagcagaaattcaaccccagtggatagcggcctcaatcatactggagtttttcctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacaactaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccagggcatgaagaaccgattcccatggctacttatggctggaatttggtcaaactccattcaggggttgacgtgttctacaaacccacagagcaggtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagatacaaccccttttgggcaacaaagagtgttcaaagagaaggtggataccagaacaccgcaaccaaaaccaggcacacgaatggtcatgactacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagccgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctaggagcgcggtttctggaatttgaagccctgggttttttgaatgaagatcattggtttggcagagaaaactcatggagtggagtggaaggggaaggtctgcacagattgggatacatcctggaggagatagacaagaaagatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacctccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 1648 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggctatcaagatactgattggattcaggaaggagataggccgcatgctgaacatcttgaacgggagaaaaaggtcaacgattacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagccttaacaccacattcaggaatgggattggaaacaagagctgagacatggatgtcatcggaaggggcttggaagcatgctcagagagtagagagctggatactcagaaacccaggatttgcactcttggcaggatttatggcttacatgattgggcaaacagggatccagcgaactgtcttctttgtcctaatgatgctggtcgccccatcctacggaatgcgatgcgtaggagtgggaaacagagactttgtggaaggagtctcaggtggagcatgggtcgacctggtgctagaacatggaggatgcgttacaaccatggcccagggaaaaccaaccttggattttgaactaaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtgaccaacatagaattagaacccccctttggggacagttacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtacaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggaatgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaaaacatgggggaaagcaaaaatcttcacccctgaaacaagaaacagcacatttttaatagatggaccagacacctctgaatgccccaatgaacgaagagcgtggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacacaatggtgttgccgctcctgcacgatgccccccttaaggttcttaggagaagatgggtgctggtatgggatggagattaggcccttgagtgaaaaagaagagaacatggttaaatcacaggtgacggctggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtggggatacacatagaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaagcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacctagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaagtagcttctgctggcatttcttacaaagatcgggaatggtgcttcactggggagagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgataacatagttatgcttcacacaacagaaagaggagggagggcctatcaacacgccctgaacgaacttccggagtcactggaaacactcatgcttgtagccttactaggtgctatgacagcaggtatcttcctgtttttcatgcaagggaaagggatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcggccaacgagatggggctgatagaaaaaacaaaagcggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccacttcacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaagaacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtgtctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccttggctctcttcaaaacctgaattctgcatcaaagtccttaacccctacatgccaacagtcatagaagagctggaaaaactgcagagaaaacatggtgggaaccttgtcagatgcccgctgtccaggaactccacccatgagatgtattgggtgtcaggagcgtcgggaaacatcgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaatccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcactagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcatagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccatttttaaactaacctatcaaaacaaagtggtgaaagtcctcagacccacaccgagaggagcggtgatggatatcatatccaggaaagaccagagaggtagtggacaagttgggacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaatgacatgggaaaggtgaggaaagatattccgcagtgggaaccatctaagggatggaaaaactggcaagaagttcctttttgctcccaccactttcacaagatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctacgtctagcctccatggccatatgctcagcagttccaacggaatggtttccaacaagtagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 1649 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaagccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgtattgaagcctcaatatcaaacataactacggcaacaagatgtccaacgcagggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaataaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccagatttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacagattaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagttaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactctcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttctggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcttgggctgacgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaagccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcctagcataaaggctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcgagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggagcaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgctagtttgccaacttacctctcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatggggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactattcttgatgagaacaacatgggctttctgtgaagtcttgactttggccacaggaccaatcttgaccttgtgggagggcaacccgggaaggttttggaacacgactatagccgtatctaccgccaatattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtgtctagagggtccagtaagatcagatggattgttgagagaggaatggtaaagccaaaagggaaagttgtagatcttggctgtgggagaggaggatggtcttattacatggcgacactcaagaacgtgactgaagtgaaagggtatacaaaaggaggtccaggacacgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaatcttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagagaaaccagacatgacaatcattgggaggaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgttaacaaaaccctgggatgtaattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggtccctttttgctcccaccactttcacaagatctttatgaaggatggccgctcactagttgttccatgcagaaaccaggatgaactgatagggagagccagaatctcgcagggggctggatggagcttaagggaaacagcctgcctaggcaaagcttacgcccagatgtggtcgcttatgtacttccacagaagggatctgcgcttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgatagacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagcaatgaaaagatacagtgctccttcagagagtgaaggagttctgtaa

SEQ ID NO: 1650 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacctttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgtttcacttgtcaacaagagatggtgaacccctcatgatagtggcaaaacatgaaagggggagacctctcttgtttaagacaacagaggggatcaacaaatgcactctcattgctatggacttgggtgaaatgtgtgaggacactgtcacgtataaatgccccctactggtcaataccgaacctgaagacattgattgctggtgcaacctcacggctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgatctggtgctagagcatggaggatgcgtcacaaccatggcccagggaaaaccaaccttggattttgaactgactaagacaacagccaaggaagtggccctgttgagaacctattgtattgaagcctcaatatcaaacataactacggcaacaagatgtccaacgcaaggggagccttatctgaaagaggaacaggaccaacagtacatttgccggagagatgtggtagacagagggtggggcaatggctgtggcttatttggaaaaggaggagttgtgacatgtgcgaagttttcatgttcggggaagataacaggcaatttggtccagattgagaaccttgaatacacagtggttgtaacagtccataatggagacacccatgcagtaggaaatgacacatccaatcatggagtcacagccatgataactcctaggtcaccatcagtggaagtcaaattgccggactatggagaactaacactcgattgtgaacccaggtctggaattgactttaatgagatgattctgatgaaaatgaaaaagaaaacatggctcgtgcataagcaatggtttttggacctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgccggagctacagaagtggactccggtgatggaaatcacatgtttgcaggacatctcaagtgcaaagtccgcatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatttcatccactcctttggctgagaataccaacagtgtaaccaacatagaactagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggccgtgcaccaggtttttggaagtgtatatacaaccatgtttggaggagtctcatggatgattagaattctaattgggctcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgataacgtgcatacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggagggaggacatgacctcactgtagtggctggggatgtgaagggggtacttaccaaaggcaagagagcactcacacccccagtgagtgatctgaaatattcatggaagacatggggaaaagcaagaatcttcaccccagaagcaagaaacagcacatttttaatagacggaccagacacctctgaatgccccaatgaacgaagagcatggaactcccttgaggtggaagactatggatttggcatgttcacgaccaacatatggatgaaattccgggagggaagttcagaagtgtgtgaccacaggttaatgtcagctgcaattaaagatcagaaagctgtgcatgctgacatgggttattggatagagagctcaaaaaaccagacctggcagatagagagagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccatgggcccatggcacttaggcaaattagagataggctttggagaatgccctggaacaacagtcacaatccaggaggattgtgaccatagaggcccatctttgaggaccaccactgcatctggaaaactagtcacgcaatggtgttgccgctcttgcacgatgcctcccttaaggttcttgggagaagatgggtgctggtatgggatggagattaggcccctgagtgaaagagaagagaacatggtcaaatcacaggtgacggccggacaaggcacatcagaaaccttttctatgggtctgttgtgcctgaccttgtttgtggaagaatgcttgaggagaagagtcactaggaaacacatgatattagttgtggtgatcactctttgtgccattatcctgggaggcctcacatggatggacttactacgagccctcatcatgttgggggacactatgtctggtagaataggaggacagatccacctagccattatggcagtgttcaagatgtcaccaggatacgtgctgggtgtgtttttaaggaaactcacttcaagagagacagcactaatggtaataggaatggccatgacaacggtgctttcaattccacatgacctcatggaactcattgatggaatatcactgggactaattttgctaaaaatagtaacacagtttgacaacactcaagtgggaaccttagctctttccttgactttcataagatcaacaatgccattggtcatggcttggaggaccatcatggctgtgttgtttgtggtcacactcattcctttgtgcaggacaagctgtctccaaaaacagtctcattgggtagaaataacagcactcatcctaggagcccaagctttgccagtgtacctaatgactcttatgaaaggagcctcaagaagatcttggcctcttaacgagggcataatggctgtgggtttggttagtctcttaggaagcgctctcttaaagaatgatgttcccttagctggcccaatggtagcaggaggtttacttctggcggcttacgtgatgagtggcagctcagcagatctgtcactagagaaggccgccaatgtgcagtgggatgaaatggcagacataacaggctcaagcccaatcatagaagtaaagcaggatgaagatggctctttctccatacgggacgtcgaggaaaccaatatgataaccctattggtgaaactggcactgataactgtgtcaggtctctaccccttggcaattccggtcacaatgaccttatggtacatgtggcaagtgaaaacacaaagatcaggagccctgtgggacgttccctcacccgctgccactcaaaaagccgcactgtctgaaggagtgtacaggatcatgcaaagagggttattcggaaaaactcaggttggagtagggatacacatggaaggtgtgtttcacacaatgtggcatgtaacaagaggatcagtgatctgccacgagactgggagactggagccatcttgggctgacgtcaggaatgacatgatatcatacggtgggggatggaggcttggagacaaatgggacaaagaagaagacgttcaggtcctcgctatagaaccaggaaaaaatcctaaacatgtccaaacgaaacctggtcttttcaagaccctaactggagaaattggagcagtaacattagatttcaaacccggaacgtctggttctcccatcatcaacaggaaaggaaaagtcatcggactttatggaaatggagtagttaccaaatcaggtgattacgtcagtgccataacgcaagccgaaagaattggagagccagattatgaagtggatgaggacatttttcgaaagaaaagattaactatcatggacttacaccccggagctggaaagacaaaaagaattctcccatcaatagtgagagaagccttaaaaaggaggctgcgaactttgattttggctcctacgagagtggtggcagccgagatggaagaggccctacgcggactgccaatccgttatcagaccccagctgtgaaatcagaacacacaggaagagagattgtagacctcatgtgtcacgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttcctcagagcaacagcccaatagaagacatcgagagggaaattccggaaaggtcatggaatacagggttcgactggataacagactaccaagggaaaactgtgtggtttgttcccagcataaaagctggaaatgacatagcaaattgtttgagaaagtcgggaaagaaagttgtccagttgagtaggaaaacctttgacacagagtatccaaaaacgaaactcacggattgggactttgtggtcactacagacatatctgaaatgggggccaattttagagctgggagagtgatagaccctagaagatgcctcaagccagttatcctaacagatgggccagagagagttattttagcaggtcctattccagtgactccagcaagcgctgcgcagagaagagggcgaataggaaggaacccagcacaagaagacgaccaatacgttttctccggagacccactaaaaaatgatgaagatcatgcccactggacagaagcaaagatgttgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatatcttataaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctatcaacacgccctgaacgaacttccggagtcactggaaacactcatgcttgtagctttactaggtgctatgacagcaggtatcttcctgtttttcatgcaagggaaaggaatagggaaattgtcaatgggtttgataaccattgcggtggccagtggcttgctctgggtagcagaaattcaaccacagtggatagcggcctcaatcatactggagttttttctcatggtactgttgataccagaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagctaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattcccaagtgaatccaacaaccttgacagcatccttagtcatgcttttagtccactatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaattttgaccttgtgggagggcaacccgggaaggttttggaacacgaccatagccgtgtccaccgccaacattttcaggggaagctacttggcgggagctggactggctttttcactcataaagaatgcacaaacccctagaaggggaactgggaccacaggagagacactgggagaaaagtggaagagacagctaaactcattagacagaaaagagtttgaagagtataaaagaagtggaatactagaagtggacaggactgaagccaagtctgccctgaaagatgggtctaaaatcaagcatgcagtatctagagggtctagcaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagtcttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctacgaagctccttcgacaggctctgcatcctccatggtgaacggggtagtgaaactgctaacaaaaccctgggatgtgattccaatggtgactcagttagccatgacagacacaaccccttttgggcaacaaagagtgttcaaagagaaggtggataccagaacaccacaaccaaaacccggaacacgaatggttatgaccacgacagccaattggctgtgggccctccttggaaagaagaaaaatcccagactgtgcacaagggaagagttcatctcaaaagtcagatcaaacgcagccataggcgcagtcttccaggaagaacaaggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggtagagccaagggaagccgagcaatctggtacatgtggctgggagcgcggtttttggaatttgaagccctgggttttttgaatgaagaccactggtttggcagagaaaattcatggagtggagtggaaggggaaggcctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtagtgaaagtcctcagacccacaccgagaggagcggtgatggatatcatttccaggaaagaccaaagaggtagtggacaagttggaacatatggtctgaacacattcaccaacatggaagttcaactcatccgccaaatggaagctgaaggagtcatcacacaagatgacatgcagaacccaaaagggttgagagaaagagttgagaaatggttgaaagagtgtggcgtcgacaggttaaaaaggatggcaatcagtggagacgattgcgtggtgaagcccctagatgagaggtttggcacttccctcctcttcttgaatgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcctaagagaaacagcctgtctgggcaaagcttacgcccagatgtggtcgcttatgtactttcacagaagggatctgcgcttggcctccatggccatatgctcagcagttccaacagaatggtttccaacaagcagaacaacatggtcaatccacgctcatcaccagtggatgaccactgaagatatgctcaaagtgtggaacagagtgtggatagaagacaatcctaatatgactgacaagactccagtccattcgtgggaagatataccttacctaggaaaaagagaggatttgtggtgtggatccctgattggactttcttccagagccacctgggcgaagaacattcacacggccataacccaggtcaggaacctgatcgggaaagaggaatacgtggattacatgccagtaatgaaaagatacagtgctccttcagagagtgaaggagttctgtaa

SEQ ID NO: 1651 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttctatcccaccaacagcagggattctgaagagatggggacagttgaagaaaaataaggccatcaagatattgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtccacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggtccctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattagaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacaaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgtctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagccgtggtaatcactctttgtgctatcatcctggggggcctcacatggatggacttgctacgagccctcatcatgttgggggacactatgtctggtagaataggaggacagacccacctagccatcatggcagtgttcaagatgtcaccgggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgccttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcttgggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtaggaatacacatggaaggtgtatttcacacaatgtggcatgttacaagaggatcggtgatctgccacgagactgggagattggagccatcttgggctgatgtcaggaatgacatgatatcatacggtgggggatggaggcttggagataaatgggacaaagaagaagacgttcaggtcctcgctatagaaccagggaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggttaccaaatcaggtgattacgtcagtgccataacacaagccgaaagaattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatctcgaccagggtggaaatgggagaggcagcagccatcttcatgaccgcaacccctcccggagcgacagatccttttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagttatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgttattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgtcttgtgtgctggacaactactcttgatgagaacaacatgggctttctgtgaagttttgactttggccacaggaccaatcttgaccttgtgggagggcaacccgggaaggttttggaacacgaccatagccgtatctaccgccaacattttcaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtccaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgagagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaactcatggagtggagtggaaggggaaggtctgcacagattgggatacatcctggaggagatagacaagaaggatggggacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgacaggttaaagaggatggcaattagtggagacgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaggatctttatgaaggatggccgctcactagttgttccatgtagaaaccaggatgaactgatagggagagccagaatctcgcagggggctggatggagcttaagggaaacagcctgcctaggcaaagcttacgcccagatgtggtcgcttatgtacttccacagaagggatctgcgtttagcctccatggccatatgctcagcagttccaacggaatggtttccaacaagcagaacaacatggtcaatccatgctcatcaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 1652 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggctatcaagatactgattggattcaggaaggagataggccgcatgctgaacatcttgaacgggagaaaaaggtcaacgataacattgttgtgcttgattcccaccgtgatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctgcctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcactcttggcaggatttatggcttatatgattgggcaaacagggatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgaccaagacaacagccaaggaagtggctctgttaagaacctattgcattgaagccttaatatcaaacataactacggcaacaagatgtccaacgcaaggagagccttatctgaaagaggaacaggaccaacagtacatttgccggagagatgtggtagatagaggatggggcaatggctgtggcttgtttggaaaaggaggagttgtgacatgtgcgaagttctcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaactgccggactatggagaactaacactcgattgtgaacccaggtctggaattgacttcaatgagatgatcctaatgaaaatgaaaaagaaaacatggctcgtgcataagcaatggtttttggatctgcctcttccatggacaacaggagcagatacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcagccacccctttggctgagaataccaacagtgtaaccaacatagaattggaacccccctttggggacagctacatagtgataggtgttggaaacagcgcactaacactccattggttcaggaaagggagttccattggcaagatgtttgagtccacatacagaggtgcaaaacgcatggccatcctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacgtgcatagctgttggtggaatcactctgtttttgggcttcacggttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagacggggtctgtggaattagatcaaccacgaggctggaaaatgttatgtggaagcaaataaccaatgagctaaactatgttctctgggaaggaggacatgatctcactgtagtggctggggatgtgaaaggggtgttgaccaagggcaagagagcactcacacccccagcgagtgatctgaaatattcatggaagacatgggggaaagcaaaaatcttcacccctgaagcaagaaacagcacatttttaatagacggaccagacacctctgaatgccccaatgaacgaagagcatggaattcttttgaggtggaagactatggatttggcatgttcacgaccaacatatggatgaaattccgagaaggaagttcagaagtgtgtgaccacaggttaatgtcagctgcaattaaagaccagaaagctgtgcatgctgacatgggttattggatagagagctcaaaaaaccagacctggcagatagagagagcatctcttattgaagtgaaaacatgcctgtggcccaagacccatacactgtggagcaatggagtgctggaaagccagatgcttattccaaaatcatatgcgggccctttttcacagcacaattaccgccagggctatgctacgcaaaccgtgggtccatggcacttaggcaaactagagatagactttggagaatgccccggaacaacagtcacaattcaggagaattgtgaccatagaggcccatctttgaggaccaccactgcatctggaaaactagtcacgcaatggtgttgccgctcctgcacgatgccccccttaaggttcttaggagaagatgggtgctggtatgggatggagattaggcccttgagtgaaaaagaagagaacatggttaaatcacaggtgacggccggacagggcacatcggaaactttttctatgggtctgttgtgcctgaccttgtttgtggaagaatgcttgaggagaagagtcaccaggaaacacatgatattagctgtggtaatcactctttgtgctatcatcctggggggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacaacactttcaattccacatgacctcatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgaaggcataatggctgtgggtttggttagtctcctaggaagcgctcttttaaagaatgatgtccctttagctggcccaatggtggcaggaggcttacttctggcggcttacgtaatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacggtgtcaggtctctaccccttggcaattccaatcacaatgaccttatggtacatgtggcaagtgaaaacacaaagatcaggagccctgtgggacgtcccttcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcggtgatctgccacgagactgggagattggagccatcatgggctgacgtcaggaatgatatgatatcatacggtgggggatggaggcttggagataaatgggacaaagaagaagacgttcaggtcctcgctatagaaccaggaaaaaatcccaaacatgtccaaacgaaacctggccttttcaagaccctgactggagaaattggagcagtaacattagatttcaaacccggaacgtctggttctcccattatcaacaggaaaggaaaagtcatcggactctatggaaatggagtggttaccaaatcaggtgattacgtcagtgccataacgcaagccgaaaggattggagagccagattatgaagtggatgaggacatttttcgaaagaaaagactaactataatggacttacaccccggagctggaaagacaaaaagaattcttccatcaatagtgagagaagccttaaaaaggaggctgcgaactttgattttggctcccacgagagtggtggcggccgagatggaagaggccctacgtggactgccaatccgttaccaaaccccagctgtaaaatcagaacacacaggaagagagattgtagacctcatgtgccatgcaaccttcacaacaagacttttgtcatcaaccagagttccaaactacaaccttatagtaatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggactgggactttgtggtcactacagacatatctgaaatgggggctaactttagagctgggagagtgatagaccctagaagatgcctcaagccagttatcctaacagatgggccagagagagtcatcttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagctattgatggagagtttcgcctcagaggggaacaaaggaagacttttgtggaattaatgaggagaggagaccttccggtgtggctgagttataaggtagcttctgctggcatttcttacaaagatcgggaatggtgcttcactggggaaagaaataaccaaattttagaagaaaacatggaggttgaaatttggactagagagggagaaaagaaaaaactgaggccaaaatggttagatgcacgtgtatacgctgaccccatggctttgaaggatttcaaggagtttgccagtggaaggaagagtataactctcgacatcctaacagagatcgccagtttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttactctgggtagcagaaattcaaccccagtggatagcggcctcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacctgagaccagcttcagcatggacgctctatgcggtagccaccacaattctgactcccatgctgagacacaccatagaaaatacgtcggccaacctatctttagcagccatcgccaaccaggcagccgtcctaatggggcttggaaaaggatggccactccacagaatggacctcggtgtgccgctgttagcaatgggatgctactctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtgatagatctagaaccaatatcctatgacccaaaatttgaaaagcaattagggcaggtcatgttactcgccttgtgtgctggacaactactcttgatgagaacaacatgggctttctgtgaagtcttgactttggccacaggaccaatcttgaccttgtgggagggcaacccgggaaggttttggaacacgaccatagccgtatctaccgccaacatttttaggggaagttacttggcaggagctggactggctttttcactcataaagaatgcacaaacccccaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaaaaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccttacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcgtcctccatggtgaacggggtggtgaaactgctaacaaaaccctgggatgtaattccaatggtgactcagttagccatgacagacacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaagaggaacagggatggacatcagccagtgaagctgtgaatgacagccggttttgggaactggttgacaaagaaagggcccttcaccaagaagggaaatgtgaatcgtgtgtctataacatgatgggaaaacgtgagaaaaagttaggagagtttggcagagccaagggaagccgagcaatctggtatatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgatcttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccagagaggtagtggacaagttggaacatatggtttgaacacattcaccaacatggaagttcaactcatccgccaaatggaagcagaaggagtcatcacacaagatgacatgcagaacccaaaagggttgaaagaaagagttgagaaatggctgagagagtgtggtgtcgataggttaaagaggatggcaattagtggagatgattgcgtggtgaaacccctagatgagaggtttggcacttccctcctcttcttgaacgacatgggaaaggtgaggaaagatattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagggaaacagcctgcctaggtaaagcttacgcccagatgtggtcgcttatgtacttccacagaagggatctgcgtctagcctccatggccatatgctcagcagttccaacggaatggtttccaacaagcagaacaacatggtcaatccatgctcaccaccaatggatgaccactgaagacatgctcaaggtgtggaacagagtgtggatagaagacaaccccaatatgattgacaagactccagtccattcgtgggaagatataccttacctagggaaaagagaggatttgtggtgtggatccctgattggactttcttctagagccacctgggcgaagaacattcacacggccataactcaggtcaggaatctgatcggaaaagaggaatacgtggattacatgccagtaatgaaaagatacagtgctccttcagagagtgaaggagttctgtaa

SEQ ID NO: 1653 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttctccgggaaaggacccttacggatggtgctagcattcattacgtttttgcgagtcctttccatcccgccaacagcagggattctgaaaagatggggacagttgaaaaagaataaggccatcaagatactgattggattcaggaaggagataggtcgcatgttaaacatcttgaataggagaagaaggtcaacaatgacattgctgtgtttgattcccaccgtaatggcgtttcacctgtcaacaagagacggcgaacccctcatgatagtggcaaagcacgaaagggggagacctctcttgtttaagacaacagaaggaatcaacaaatgcaccctcattgccatggacctgggtgaaatgtgtgaagacactgtcacgtataaatgtcctctactagttaacaccgaacctgaagacattgattgctggtgcaatctcacgtccacctgggtcatgtacgggacatgcacccagaacggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgcttctggcaggatttatggcttacatgattgggcaaacaggaattcagcgaactgttttctttgtcctaatgatgctagtcgccccatcctacggaatgcgatgcgtaggggtagggaacagagactttgtggaaggagtctcgggtggagcatgggtcgacctggtgctagaacatggaggatgtgtcacaaccatggcccagggaaaaccaaccttggattttgaactgaccaagacaacagctaaggaagtggctctgttaagaacctattgcattgaagcttcgatatcaaacataaccacggcaacaagatgtccaacgcaaggagagccttatctcaaagaggaacaagaccaacagtacatttgccggagagacgtggtagacagagggtggggcaatggctgtggcttgtttggaaaaggaggagttgtgacgtgtgcgaagtttttatgctcggggaagataacaggcaatctggtccaaattgaaaaccttgaatatacggtagttgtgacagtccacaatggagacacccatgcagtaggaaatgacacatccaatcatggagtgacagctacgataactcccaggtcaccatcggtagaagttaaattgccggactatggggaactaacactcgattgtgaacccaggtccggaattgatttcaatgagatgattctgatgagaatgaaaaagaaaacgtggcttgtgcacaaacaatggtttttggacctacctctaccatggacagcaggagcagacacatcagaagttcattggaattataaagagagaatggtgacattcaaagttcctcatgccaagagacaggatgtgacagtgctaggatctcaggagggagctatgcattctgccctcgccggagccacagaagtggattctggcgatggaaatcacatgtttgcaggacatctcaagtgcaaagttcgtatggagaaattgagaattaagggaatgtcatacacgatgtgttcaggaaagttctcaattgacaaagagatggcagaaacacagcatgggacaacagtagtgaaagtcaagtatgaaggcgctggagctccgtgcaaagtccccatagagataagagatgtgaacaaggaaaaagtagttgggcgcatcatctcatccaccccttttgctgagagtaccaacagcgtaaccaacatagaattagaacccccttttggggacagctacatagtgataggtgttggagacagtgctttaacactccattggttcaggaaagggagctccattggcaagatgtttgagtccacatacagaggtgcaaaacgaatggccattctaggtgaaacagcttgggattttggttctgttggtggactgttcacatcactgggaaaggctgtacaccaagtttttggaagtgtgtatacaaccatgtttggaggggtctcatggatgattagaatcctaattgggttcttagtattgtggattggcacgaattcaagaaacacttcaatggcaatgacgtgcatagctgttggaggaattactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcttctgcaatattgaatgcccacaaagatggggtctgtggaatcagatcaaccacgaggctggaaaatgttatgtggaagcaaataaccaacgagctaaactatgttctctgggaaggaggacatgatctcactgtagtggccggggacgtgaagggggtgttgaccaaaggcaagagagcactcacacctccagtgaatgatctgaaatattcatggaagacatggggaaaagcaaaaatctttaccccagaagcaagaaacagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaatcaaagatcagaaagctgtgcatgctgacatgggttattggatagagagctcaaagaaccagacctggcagatagagaaagcatcccttattgaggtgaaaacatgtctgtggcccaaaacccacacgctgtggagcaatggagtgctggaaagtcagatgctcattccaagatcatatgcaggccctttttcacaacacaattaccgccagggctatgccacgcaaaccgcgggcccatggcacttaggcaaattggagatagactttggagaatgccccggaacaacagtcacaattcaggacgattgtgaccatagaggcccatctttgaggaccaccactgcatctggaaaactggtcacgcaatggtgctgccgctcctgcacgatgcctcccttaaggttcttgggagaagatggatgttggtatgggatggagattaggcccttgagtgaaaaagaagagaacatggtcaaatcacaggtaacagccggacaaggcacatcagaaactttttctatggggttgctatgcctgaccttgttcgtggaagaatgcttaaggagaagagtcactaggaaacacatgatattggttgtggcaatcaccttctgtgctatcatcctaggaggtctcacatggatggacttactacgagcccttatcatgttaggggacactatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggttgatattactaaaaatagtaacacactttgatgacacccaagtgggaaccttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcctaaagaatgatgttcctttagctggcccaatggtggcaggaggcttacttctagcggcttacgtaatgagtggtagctcagcagacctgtcactagagaaggctgctagtgtgcagtgggatgaaatggcggacataactggctcaagcccaatcatagaagtgaagcaggatgaagatggctctttctccatacgggatgtcgaggaaaccaacatgataaccctcttggtgaaactggcgctgataacagtatcaggtctttaccccttggcaattccagtcacaatggcactatggtatatttggcaagtgaaaacacaaagatcaggagctctgtgggacgttccctcacccgctgccactcagaaagccacactgtctgaaggggtgtataggatcatgcaaagagggttgtttgggaaaactcaggttggagtagggatacacatggaaggtgtgttccacacaatgtggcacgtgacaagaggatcagtgatctgccatgagacagggagattagagccatcttgggctgacgtcaggaatgacatgatatcatacggtgggggatggaggctcggagacaaatgggacaaagaagaagatgttcaggtcctagccatagaaccaggaaaaaatcctaaacatgtccaaacgaaaccaggccttttcaagaccctaactggagaaattggagcagtaactctggatttcaaacccggaacgtctggctctcctatcattaacaagaaagggaaagttattggactctatggaaatggagtagttaccaaatcaggtgattacgtcagtgccataacgcaagccgaaagaattggtgagccagattatgaagtggatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcagccgagatggaagaggccctacgcggactgccaatccgttatcagaccccagctgtgaaatcagagcacacaggaagagagattgtagacctcatgtgtcatgcaaccttcacaacgagacttttgtcatcaaccagggttccaaattataacctcatagtgatggatgaagcacatttcactgacccttgtagtgtcgcggctagaggatacatttcaaccagggtggaaatgggagaggcagcagctatcttcatgactgcaacccctcctggatcgacagatccctttccccagagcaacagcccaatagaagacatcgagagggaaatcccagaaaggtcatggaacacagggttcgactggataacagactaccaagggaaaactgtgtggtttgttcctagcataaaagctggaaatgacattgcaaattgtttgagaaagtcgggaaagagagtgatccagttgagcagaaaaacctttgacacagagtatccaaagacgaaactcacggactgggattttgtggtcaccacagacatatctgaaatgggggccaatttcagagctgggagagtgatagaccccaggagatgcctcaagccagttatcctaacagatgggccagagagagttattctagcaggtccaattccagtaactccagcaagtgccgctcagagaagagggcgaataggtaggaatccagcacaagaagatgaccaatatgttttctctggagacccactaaagaatgatgaagatcatgctcactggacagaagcaaaaatgttgcttgacaatatctacacccctgaagggataattccaacattgtttggtccggaaagggaaaaaacccaagccattgatggagagtttcgcctcagaggggaacaaaggaagacttttgtggaattgatgaggagaggagaccttccggtgtggctgagctacaaggtagcttctgccggtatctcttacaaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccccatggctctgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacacgctctaaacgaactcccggagtcactggaaacactcatgcttgtagccctactaggtgctatgacagccggtatcttcctgtttttcatgcaggggaaaggaatagggaaattgtcaatgggtctgatagccatagctgtggctagtggcttgctctgggtagcagaaattcagccccagtggatagcagcttcaatcatactggagttttttcttatggtgctgttgataccagaaccagaaaaacaaaggaccccacaagacaatcaactgatctacgttatattgaccattctcaccattattggtctcatagcagccaatgagatggggctgattgaaaaaacaaaaacggactttgggttctaccaggcaaaaacagaaaccaccattcttgatgtggatttgagaccagcctcagcatggacactctatgcagtggccaccactattctgactcccatgctgagacacaccatagagaacacgtctgccaacctatctctagcagccattgccaaccaagcagctgtcctaatgggacttggaaaaggatggccgctccacagaatggacctcggtgtgccgctgttggcaatgggatgttattctcaagtgaacccaacaaccctgacagcatccctagtcatgcttttagtccattatgccataataggtccaggattgcaggcaaaagccacaagagaggcccagaaaaggacagctgctgggatcatgaagaaccccacggtggacgggataacagtaatagatctagaaccaatatcctatgacccaaaatttgaaaagcaattagggcaagtcatgctactagtactgtgtgttggacaattacttttgatgagaacaacatgggctctctgcgaagtattgactttggccacaggaccaatcatgaccttgtgggagggcaacccgggaaggttttggaacacgaccatagctgtatccacagccaacatttttagaggaagctacttggcgggagctggactagctttttcgctcataaagaatgcacaaacccctaggaggggaactgggaccacaggagagacactgggagagaagtggaagagacagctaaactcattagacagaaaagagtttgaagagtacaagagaagtggaatactagaagtggataggactgaagccaagtctgccctaagagatggatctaaaaccaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaaggatatacaaaaggaggcccaggacatgaagaaccaatccccatggccacttatggctggaatttggtcaaactccattcaggggttgatgtgttctacaaacccactgagcaggtggacaccctgctctgtgacattggggagtcatcctctaatccgacaatagaggaaggaagaacattgagagtcttgaagatggtggagccatggctctcttcaaaacctgagttctgcatcaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaacagaaaaaccagacatgacaatcattgggagaaggcttcagagattgcgagaagagcacaaagaaacctggcactatgaccaggaaaacccatacagaacctgggcgtatcatggaagctatgaagctccttcgacaggctcagcatcctccatggtgaacggggtagtaaaattgctgacaaaaccttgggatgtgattccaatggtgacccagttggccatgacagacacaaccccttttgggcaacaaagagtgttcaaggagaaggtggatactagaactccacaaccaaaacccggcacacgaatgattatgaccacgacagccaattggttgtgggccctcctcgggaagaagaaaagtcccagactgtgcacaaaggaagagttcatcttaaaagttaggtcaaatgcagccataggcgcagtctttcaggaagaacagggatggacatcagccagtgaagctgtgaatgacagccggttctgggaactggttgacaaagaaagggctctgcaccaggaaggaaaatgtgaatcgtgtgtctataacatgatgggaaaacgtgagaaaaaattgggagagtttggtagggccaagggaagccgagcaatctggtacatgtggctgggggcgcggttcctggaatttgaagccctgggttttttgaatgaagatcactggtttggcagagaaaactcatggagtggagtggaaggggaaggtctgcacagattgggatacatcttggaggacatagacaagaaggatggagacctgatatatgctgacgacacagcaggttgggacacgagaatcactgaggatgaccttttaaatgaagaactgatcacagaacagatggcccctcaccacaagaccctagccaaagccattttcaaactaacctatcaaaacaaagtggtgaaagtcctcagacccacaccgaaaggagcggtaatggacattatatccaggaaagaccaaagaggtagtggacaggttggaacatatggtttaaacacattcactaacatggaagttcaactcatccgtcaaatggaagctgaaggagtcatcacacaagacgacatgcagaacccaaaagggttgaaagaaagagttgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacatcccgcagtgggaaccatccaagggatggaaaaactggcaagaggttcctttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctagcctccatggccatatgctcagcagttccaacagaatggtttccaacaagcagaacaacatggtcaatccacgctcatcaccagtggatgaccactgaagatatgcttaaagtgtggaacagagtgtggatagaagacaaccccaacatgactgacaagactccagtccattcgtgggaagacataccttacctagggaagagagaggatctgtggtgtggatccctgattggactttcctccagagccacctgggcgaagaacattcacacggccataacccaggtcaggaatctgatcggaaaagaggaatacgtggattacatgccagtcatgaaaagatacagcgctccttccgagagtgaaggagttctgtaa

SEQ ID NO: 1654 - DNA, 10164 bp, Dengue virus
atgaaccaacgaaaaaaggtggctagaccgcctttcaatatgctgaaacgcgagagaaaccgcgtatcaacccctcaagggttggtgaagagattctcaacaggactgttctccgggaaaggacctttacggatggtgcttgcattcatcacgttcttacgagtcctttccatcccaccaacagcagggattctgaaaagatgggggcagttgaaaaagaataaggccatcaagatactgactggattcaggaaggaaataggccgcatgctgaacatcctgaacggaagaaagaggtcaacaatgactctgttatgtctgatccccaccataatggcattccacttatcgtcaagagacggcgaacccctcatgatagtagcgaaacacgaaagggggagacctcttttgtttaagacaacggaaggaatcaacagatgcactctcattgccatggacgtgggtgaaatgtgtgaggacaccgtcacatataaatgccccctactggtcaacactgagcctgaagacattgattgctggtgcaactccacatccacttgggtcacgtatggaacgtgtacccagagtggggaacggagacgggagaagcgctcagtggcactggcaccacattcaggaatgggattggaaaccaggacagagacgtggatgtcatcggagggggcatggaaacatgcccagagagtggagagctggatacttagaaatccaggatttgcactcttggcaggatttatggcttacatgattggacagacaggaattcaacgaacagtcttctttgtcctcatgatgttggtcgctccatcctatggaatgcgatgcgtgggagtggggaatagagattttgtggaaggagtctcaggaggaacatgggtcgacctggtgctggaacacggaggatgtgttacaaccatggcacagggaaagccaaccttggattttgaattgatcaagacaacagcaaaggaggtagctctattaagaacttattgcatagaggcctcaatatcaaacataaccacggcaacaagatgtccaacacaaggagaaccttatcttaaagaggaacaagaccagcagtacatttgcagaagagacgtggtagacagaggatggggtaatggctgtggcctatttggaaaaggaggagttgtaacatgcgcaaagttttcatgctcggggaaaataacaggcaacctggtccaagttgaaaaccttgaatacacagtggttgtgacagttcataatggggatgcccacgcagtgggaaacagcacgtccaatcatggagtaacaaccacaataacccccaggtcaccatcggtagaagttaaactaccagattatggggaactgacactcgattgcgaacccaggtccggaatcgactttaacgaaatgatcctgatgaaaatgaaaggaaaaacatggcttgtgcacaaacaatggttcttagatctacccctgccatggacagcaggagctgacacatcagaagtccattggaattataaagagagaatggtgacgttcaaagtacctcatgccaagagacaggatgtcacagtgctaggatcccaggaaggagccatgcactctgccctcactggagctacggaggtggattctggtgacggaaaccacatgtttgcagggcacctaaagtgcaaagtgcgcatggaaaaattgaggatcaagggaatgtcatacacgatgtgctcaggaaagttttccatcgacaaggaaatggcagaaacgcagcacgggacaacagtggtgaaggtcaagtatgaaggcactggggctccatgcaaaattccaatagaaataaaagacatgaataaggaaaaagtggttggacgcattatttcatctattccctttgctgaaaacaccaacagcataaccaatattgaactcgaacccccctttggggacagctacatagtgataggcgctggagacagtgcattgacactccattggtttaggaagggaagttctatcgggaagatgtttgagtccacttatagaggtgcaaaaagaatggccattttgggtgaaacagcatgggattttggctccgttggtggattgtttacatcattagggaaagctgtgcatcaggtttttggcagtgtctacacaacaatgtttgggggagtctcatggatgatcagaattctcattgggattttagtattgtggatcggcacgaactcaagaaacacttcaatggcaatgtcatgcatagctgttggaggaatcaccttatttcttggttttacggtccaagcagacatgggctgtgttgtgtcatggagtggaagagaattgaagtgtggaagtggaatcttcgtgatagacaatgtgcacacttggacggaacagtacaaatttcaaccagagtccccagcgagattagcgtccgctatactgaatgcccataaggatggggtctgtggagttagatcaaccacaagactggaaaatgtgatgtggaaacaaataaccaatgaactaaactacgttctctgggagggaggacatgacctaactgtggtaactggagatgtgaaaggggtgttgaccaaaggcaagagagtgattgcacctccggtgagtgatttgaaatattcatggaaaacatgggggaaagcaaaaatttttactccagaagcaaggaataacacattcctgatagatggaccagatacctctgaatgccccaatgagcgaagagcgtggaatttccttgaggtagatgactatggatttggcatgttcacgaccaacatatggatgaaacttcgagaggggagttcagaggtatgtgaccataggttgatgtcagcggcagtcaaagatcagagggccgtgcatgctgacatgggctactggatagagagctcgaagaatcagacctggcagatagagaaagcatcccttattgaagtgaaaacatgcttatggcccaagactcacacattgtggagcaatggagtgctagaaagccagatgctcattcccaaaacgtatgcaggtccctcttcacaacacaattaccgccaaggctatgctacgcagaccatgggcccgtggcacttgggcaagttggaaatggactttggagagtgtcctggaacgacagtcacaattcaggagaattgtggccacagaggtccatctctgagaaccaccacagcatctggaaaactggtcacacagtggtgctgccgttcctgcacaatgccccccctaagattcttgggagaggatgggtgttggtatggaatggaaatcagaccctcaagtgagaaagaagagaacatggtcaaatcacaggtggcggctgggcaaggtccatcagaaactttctctatggggttgttgtgtttgaccctattcatggaagaatgcctaaggcgaagagtcactagaaaacacatgatactggttgtggtagctaccctctgtgccatcattttgggaggtctcacgtggatggacttagtacgagccattatcatgttgggagataccatgtttggtagaatgggaggacaagttcacctagccatcatggcagtttttaagatgtcaccaggttacgtgctcggtgtgtttttgagaaagctcacttcaagagagacagcactgatggtgataggaatggcaatgacaacggtgttttcaattccacatgacctcatggaattgattgatggaatagcgttagggctaatcttgctgaaaatggtagtgcattttgacaatgctcaattgggaactctagctctttctttaactttcataaaaacaacaatgccattgatcatggcttggaggaccatcatggttgtgctctttgtggtcacactcattcccttgtgtagaacgagttgtctccagaagcagtcccactgggtagaaataacagcaatcatcttgggagctcaagccttgccggtgtatttgatgaccctcatgaagggggcttcaaaaagatcctggccccttaacgagggcataatggctgtgggcttggttagcctcctgggaagcgccctgctaaagaacgacgttcccctggctggtccaatggtggcgggaggtttactcctagcggcttacgtgatgagcggtagttcagcagacctatcgcttgagaaggccgctaacgtgcagtgggatgagatggcggacataacaggctcaagtccagtcatagaggttaaacaagatgaagatggctcattctcaatacgggatgttgaggaaactaacttgataaccctactggtgaaactggcactaataactgtgtcaggtctctatcccttggctatcccagtcacaatggctttgtggtacatgtggcaagtgaaaacgcaaagatcaggagccttgtgggatgttccctcaccagccaccgctcagaaagccatgttgactgaaggagtatacaggatcatgcagagaggattgcttgggaaaacccaggttggggtaggagtacacgtggagggtgtgttccacaccatgtggcatgtgacaagaggatcggtgatctgtcatgagactggaagactggagccatcatgggctgatgtcaggaatgacatgatatcatacggtgggggatggagactcggtgaaaaatgggacaaagaagaggatgtgcaggtcctggccgtggaaccgggaaaaaatccaaaacacgtccaaacgaaacctggcctttttaagactcttactggggaaataggagcagtaacattagactttaaacctggaacatctggatctccaattatcaacaagaaaggaaaggtcattggactttatggaaatggagtggttaccaaatcaggtgattacgtcagtgccataacgcaagctgaaaagatcggcgagccggactatgaagtggatgaggacatctttagaaagaaaaggttgaccgtaatggacctacatcctggagctggcaaaacaaaaagaatcctaccatcaattgtcagagaagctctgaaaaggagactgcggaccctgattctggctcccacgagagtagtggcagctgaaatggaagaggctcttcgcggattaccaatccgctaccagaccccagccgtgaaagcagaacacacaggaagagagattgtggacctcatgtgccatgcaaccttcacgacaagactcctgtcatcaaccagagttccaaattacaacctcatagtaatggatgaagcgcatttcacagatccctctagtgtagcagcgagaggctacatatctaccagagtggaaatgggagaggcagcggctatcttcatgactgcaacaccccctggaacaatagacccttttccccagagcaacagcccaatagaagatatcgaaagagagatcccagaaaggtcatggaatacaggattcgactggatcacggattaccaagggaagacggtgtggtttgttcccagcataaaagctggaaatgacattgcaaactgcttaagaaagtctggaaagaaggtgatccagttgagcaggaaaacctttgacacggagtatccaaaaacaaaactcaccgattgggactttgtggtcaccacagacatatctgaaatgggagccaattttagagctgggagagtgatagatcctaggagatgccttaagccagtcatcctaacagatgggccagagagggttattttggcagggcctatcccagtgactccggcaagtgctgcccagagaagagggcggataggtagaaacccagcacaagaggacgaccagtacgtcttctctggagacccattgaaaaatgatgaagatcatgcgcactggacagaggcaaagatgctgcttgacaatatctacaccccggaaggaatcattcccaccctgtttggtccggaaagggaaaaaacccaagccattgatggagagtttcgcctcagaggggaacaaaggaagacttttgtagaactaatgaggagaggagaccttccggtgtggctaagctataaggtagcttcagctggtatttcatacagagaccgggaatggtgttttacaggggagaggaacaaccaaattttagaggaaaacatggaggttgagatctggaccagagagggagaaaagaaaaagcttagaccaaaatggttggatgctcgagtctatgctgatcccatggctctaaaagatttcaaagagttcgctagtggaaggaaaagtataaccctggacattctgacagagattgccagcttgccgacctacctatcctctagggccaaactcgctcttgacaacatagtcatgctacacacaacagaaaagggagggagggcctaccaacatgccctcaatgagctcccagaatcattggagacactcatgctcatcgccctgttaggtgccatgacagcaggcattttcctattttttatgcaggggaaagggatagggaaactgtcaatgggtttgattgctattgcagtagctagtggcttactctggatagcagagatccaacctcaatggatagcggcctcaatcatactggagttttttctcatggtacttttaataccagagccagaaaagcaaagaaccccacaagacaaccagttgatctatgttatactggccctcctaaccatcatcagcctcatagcagccaatgagatggggttgattgaaaaaactaaaacggattttgggttctaccaggaaaaaccagagaccactatccttgatgtggatctgcgacctgcttcagcatggacactctatgcagtagcaactacaatcctgacccctatgctgagacacactatagaaaacacatctgctaacctgtctttggctgccattgccaatcaagcagctgtcctgatgggcctcggaaaaggatggccgcttcacaggatggaccttagtgtgccattgctagcattgggatgttactctcaagtgaaccctacaactctgacagcatccttagtcatgctattagtccattatgcaataataggccccggattacaggcaaaagccacaagagaggcccagaaaaggacagcagctggaatcatgaaaaatcccacagtggatggaataacagtgatagacctggaaccaatatcttatgacccaaagtttgaaaaacaattagggcaggtcatgcttttagtcctgtgtgctggacagttactcttgatgaggacaacctgggctttctgtgaggttttgactttgtctacaggaccagccttaactctatgggaaggtggtccaggaagattctggaacacaactatagctgtgtccacagccaacatctttagaggaagctatttagccggagctggactggccttctcactcataaaaaacacacaaacccccagaagggggactggcatcacaggagaaacactgggagagaagtggaaaagacagttaaattcactagataggaaggaatttgaagaatacaagaggagtggaatactagaagtagacaggactggagccaaactagccttgaaagatggttccaagatcaaacatgcagtgtctagaggatccagtaagatcagatggattgttgagagagggatgataaagccaaaagggaaagtcgtggatcttggttgtggaagaggaggatggtcctattacgtggcgacactcaagaatgtgaccgaagtgagggggttcacgaaaggaggaccaggacacgaagaaccaattcccatggctacctatggttggaacttagtcaagctccactccggggttgacgtgttctacaaacccactgagcaggtggacaccctgctctgtgacattggagaatcatcctctaatccaacaatagaggaaggaagaacactaaggattctaaggatggtagagccatggctttcttcaaaaccggaattctgcattaaagtccttaacccctacatgccaacagtcatagaggaactagaaaagctacaaagaaagtatggtggaaatcttatcagatgcccactgtccaggaattccacccatgaaatgtactgggtgtcaggagcctcggggaacatagtgagttctgtgaacacagtatcaaagatgctgttaaacaggtttaccacgaaacatagaaaacccacctacgaaaaggacgtggaccttggggcaggaacaaggagtgtttccaccgagacagaaaaaccagacatgacggtcatcgggagaaggctccagcgattgcaagaagaacacaaagagacttggcactatgatcaagagaatccatacagaacctgggcgtatcatgggagctatgaagccccctcgacaggctcagcttcttctatgataaatggggtggtaaagttgctgacaaaaccctgggacgtgattccaatggtgacccagttagctatgacagacacaactccctttgggcaacagagagtgtttaaggagaaagtggacaccagaacaccacaacccaaaccaggcacacgggtggttatgaccacaacagctaactggctatgggcattgctcggaagaaagaagaaccctaggctgtgcacgagagaagagtttatctcaaaagttagatcgaatgcagctataggtgcagtttttcaagaggaacagggatgggcttcagctagtgaagctgtgaatgatagccggttctggaaattggttgacaaggaaagagccttacatcaggaagggaagtgtgaatcgtgtgtctacaacatgatgggaaaacgtgagaaaaaactaggagagtttggaagagccaaaggaagccgggcaatttggtacatgtggctaggagcacggtttctggaatttgaagctctgggattcttaaatgaagatcactggtttggaagagacaattcatggagtggagtggaaggagaaggtctacatagactaggatacatcctagaggacatagataaaaaggaaggagacctgatgtacgctgatgacacagcaggttgggacacaagaatcactgaagatgacctcctgaatgaagagctgattacggaacagatggcccctggtcataagatcttggccaaagccattttcaaactaacctatcaaaacaaagtggtaaaagtccttagaccgaccccaaagggagcagtgatggacatcatttccagaaaagaccaaaggggcagtggacaagttggaacatatggattgaacacattcacaaacatggaagtgcaactcatccgccagatggaagctgagggagtcatcacacaagatgatatgcagaacccaaaagggctgaaggaaaaagttgagaaatggctaaaagagtgtggtgttgacaggctgaagaggatggcaattagtggggatgactgtgtggtgaagcctctagatgagaggtttagcacatcccttctcttcctgaacgacatgggaaaggtgagaaaagacatcccgcagtgggaaccctccaagggatggaaaaattggcaagaagttcctttttgctcccatcatttccacaagatcctcatgaaggacggccgctcactagtggtcccatgtagaaaccaggatgagctaatagggagggctaggatttcacaaggggcgggatggagcttaaaagaaacagcctgcctggggaaggcttacgctcagatgtggtcgctcatgtattttcataggagggacctacggttagcctccatggccatatgttcagcggttccagtggagtgggttccaacaagtagaacaacatggtcgattcacgcccaccatcagtggatgaccactgaggacatgctcaaagtatggaatagagtgtggatagaggacaaccccaacatgactgacaaaactccagtctattcttgggaagacataccttacctaggaaaaagagaggatctatggtgtggctccctgattggactcacctcgagagccacctgggcaaaaaatattcagacagccataacccaagtcagaaacttgattgggaaagaggagtatgtggattacatgccagccatgaaaagatacagcgctcccctagaaagtgaaggagttctgtaa

SEQ ID NO: 1655 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcctgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccaggatttgcgctcttggcaggatttatggcttatatgattgggcaaacaggaatccagcgaactgtcttctttgtcctcatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaattgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacaaccacgataactcccaggtcaccatcggtggaagtcaaattgccggactatggagaactaacactcgattgtgaacccaggtctggaattgactttaatgagatgatcctaatgaaaatgaaaaagaaaacatggctcgtgcataagcaatggtttttagatttgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaagctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggaaagagttgaagtgtgggagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacttttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcaaatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcactattcaggaggattgtgaccatagaggcccatctctgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaagtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccagggtacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctgggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagctgaaagaattggagagccagattatgaggtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtaactccagcaagcgctgctcagagaagagggcgaataggaaggaacccaacacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattctagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccttgaacgaacttccggagtcactggaaacactcatgcttgtagccttactaggtgctatgacagcaggcatcttcctgttttttatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggactccacaagacaatcaattgatctacgtcatattgaccattctcaccattattggtctaatagcagccaacgagatggggctgatagaaaaaacaaaaacggattttgggttttaccaagtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccgacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgctaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatctcggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatatgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgggcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccttacctagggaaaagggaggatttgtggtgtggatccctaattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 1656 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaaacatgctcagagagtagagagctggatactcagaaacccaggatttgcgctcttggcaggatttatggcttatatgattgggcaaacaggaatccagcgaactgttttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaagctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaattactctgtttttgggcttcacggttcaagcggacatggggtgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgacctgaaatattcatggaagacatggggaaaagcaaaaatcttcaccccagaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacagattaatgtcagctgcaattaaagatcaaaaagctgtgcatgctgacatgggttattggatagagagctcaaaaaaccagacctggcagatagagaaagcatctcttattgaagtgaaaacatgtctgtggcccaagacccacacactatggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggaccgggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccagggtacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaaaaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgctataacgcaagccgaaagaattggagagccagattatgaggtggatgaggatatttttcgaaagaaaagattaactataatggacttacaccccggagctggaaagacaaaaagaattcttccatcaatagtgagagaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttatcaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacctatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagagacatggcattatgatcaggaaaacccatacagaacctgggcgtaccatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgagtggttatgaccacgacagctaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagctattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacgcaagatgacatgcagaacccaaaagggttgaaagaaagagttgagaaatggctgagagagtgtggtgtcgacaggttaaagagaatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccctacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 1657 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagctgaagaaaaacaaggccatcaagatactgattggattcaggaaggagataggccgcatgctgaacatcttgaacgggagaaaaaggtcaacaataacattgttgtgcttgattcccactgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctattggtcaataccgaacctgaagacattgattgctggtgcaacctcacgtctacctgggtcatgtatggaacatgcacccagagtggagaacggagacgagagaagcgctcagtagctttaacaccacattcaggaatgggattggaaacaagagctgagacatggatgtcatcggaaggggcttggaagcatgctcagagagtagagagctggatactcagaaacccaggatttgcgctcttggcaggatttatggcttacatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgttagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtagaagtcaaattgccggactatggagaactaacactcgactgtgaacccaggtctggaattgactttaatgagatgatcctaatgaaaatgaaaaagaaaacatggctcgtgcataagcaatggtttttggatttgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggtttaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggccatgacctgcatagctgttggaggaatcactctgtttttgggctttacagttcaagcggacatgggttgtgtggtgtcatggagtgggagagaattgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgttatgtggaagcaaataaccaatgagctaaactatgttctctgggaaggaggacatgatctcactgtagtggctggggatgcgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggtatgtttacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacttggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccaggatacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccctagctctttccttgactttcataagatcaacaatgtcattggtcatggcttggaggaccattatggctgtgttgtttgtggtcacactcattcccttgtgcaggacaagctgtcttcagaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggctattcgggaaaactcaggttggagtagggatacacatggaaggtgtgtttcacacaatgtggcatgttacaagaggatcagtgatctgccacgagactgggagattggagccatcttgggctgacgtcaggaatgacatgatatcatacggtggaggatggaggcttggagacaaatgggacaaagaagaagacgttcaggtcctcgctatagaaccaggaaaaaatcccaaacatgtccaaacgaaacctggccttttcaagaccttaactggagaaattggagcagtaacattagatttcaaacccggaacgtctggttctcccattatcaacaggaaaggaaaagtcatcggactctatggaaatggagtggtcaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctgcgaactttgatactggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgactagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgacacagaatatccaaaaacgaaactcacggactgggactttgtggtcactacagatatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatctcttacaaagatcgggaatggtgcttcactggggaaagaaataaccaaattttggaagaaaacatggaggttgaaatttggactagagagggagaaaagaaaaaactgaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgacaacatagtcatgctccacacaacagaaagaggagggagggcctaccaacacgccctgaacgaacttccggagtcactggaaacactcatgcttgtagccttactaggtgctatgacagcaggtatcttcctgtttttcatgcaagggaaaggaatagggaaattgtcaatgggtttgataaccattgcggtggctagtggcttgctctgggtagcagaaattcaaccccagtggatagcggcctcaatcatactggagttttttctcatggtactgttgataccagaaccagaaaaacaaaggaccccacaagacaatcaattgatctacgtcatattgaccattctcaccatcattggtctaatagcagccaacgagatggggctgatagaaaaaacaaaaacggattttgggttttaccaggcaaaaacagaaaccaccatcctcgatgtggacttgagaccagcttcagcatggacgctctatgcggtagccaccacaattctgactcccatgctgagacacaccatagaaaacacgtcggccaacctatctctagcagccatcgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggctcagaaaaggacagctgctggaatcatgaaaaatccaacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttaaccttgtgggagggcaacccgggaaggttttggaacacgaccatagccgtatccaccgccaacattttcaggggaagttacttggcgggagctggattggctttttcactcataaagaatgcacaaacccctaggaggggaactgggaccataggagagacactgggagagaagtggaagagacagctaaactcattagacaggaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggctggaatttggtcaaactccattcaggggttgacgtgttctacagacccacagagcaagtggacaccctgctctgtgatattggggagtcatcttctaatccaacaatagaggaaggaagaacattaagagttctgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactctacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaggagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaaattaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggctgaaagaaagagttgagaaatggctgagagagtgtggtgtcgacaggttaaagaggatggcaatcagtggagacgactgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacgacatggtcaatccatgctcatcaccaatggatgaccactgaagacatgctcaaagtgtggaacagagtgtggatagaagacaaccccaatatgattgacaagactccagtccattcgtgggaagatataccttacctagggaaaagagaggatttgtggtgtggatccctgattgggctttcttccagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 1658 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttccgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgttgtgcttgattcccaccgtaatggcgtttcacttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttgacaccacattcaggaatgggattggaaacaagagctgagacatggatgtcatcggaaggggcttggaagcatgctcagagagtagagagctggatactcagaaacccagggtttgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatctgccggagagatgtggtagacagaggatggggcaatggctgtggcttgtttggaaaaggaggagttgtgacatgtgcgaagttttcatgttcggggaagataacaggcaatctggtccaaattgagaaccttgaatacacagtggttgtaacagtccacaatggagacacccatgcagtaggaaatgacacatccaatcatggagttacagccacgataactcccaggtcaccatcggtggaagtcaaattgccggactatggagaactaacactcgattgtgaacccaggtctggaattgactttaatgagatgatcctaatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatctcaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgcgttatctcatccacccctttggctgagaataccaacagtgtaaccaacatagaattagaacccccctttggggacagctacatagtgataggtgttggaaacagcgcattaacactccattggttcaggaaagggagttccattggtaagatgtttgagtccacatacagaggtgcaaaacgaatggccattctaggtgaaacagcttgggattttggttccgttggtggactgttcacatcattgggaaaagctgtgcaccaggtttttggaagcgtgtatacaaccatgtttggaggagtctcatggatgattagaatcctaattgggttcttagtgttgtggattggcacgaactcaaggaacacttcaatggccatgacgtgcatagctgttggaggaatcactctgtttttgggcttcacggttcaagcggacatgggttgtgtggtgtcatggagtgggagagagttgaagtgtggaagcggaatttttgtggttgacaacgtgcacacttggacagaacagtacaaattccaaccagagtccccagcgagactagcgtctgcaatattaaatgcccacaaagatggggtctgtggaattagatcaaccacgaggctggaaaatgtcatgtggaagcaaataaccaatgagctaaactatgttctctgggaaggaggacatgatctcactgtagtggctggggatgtgaagggggtgttgaccaaaggcaagagagcactcacacccccagtgagtgatctgaaatattcatggaagacatggggaaaagcaaaaatcttcacccctgaagcaagaaacagcacatttttaatagacggaccagacacctctgaatgccccaatgaacgaagagcatggaattctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaactagagatagactttggagaatgccccggaacaacagtcacaattcaggaggattgtgaccatagaggcccatctttgaggaccaccactgcatctggaaaactagtcacgcaatggtgttgccgctcctgcacgatgccccccttaaggttcttgggagaagatggatgctggtatgggatggagattaggcccttgagtgaaaaagaagagaacatggtcaaatcacaggtggcggccggacagggcacatcagaaactttttctatgggtctgttgtgcctgaccttgtttgtggaagaatgcttgaggagaagagtcactaggaaacacatgatattagctgtggtaatcactctttgtgctatcatcctgggaggcctcacatggatggacttgctacgagccctcatcatgttgggggacactatgtctggtagaataggaggacagacccacctagccatcatggcagtgttcaagatgtcaccagggtacgtgctgggtgtgtttttaaggaaactcacttcaagagagacagcactaatggtaataggaatggccatgacaacgacactttcaattccacatgaccttatggaactcattgatggaatatcactaggactaattttgctaaaaatagtaacacagtttgacaacacccaagtgggaaccttagctctttccttgactttcataagatcaacaatgtcattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaaaaatgatgtccctttagctggcccaatggtggcaggaggcttacttctggcggcttacgtgatgagtggcagctcagcagatctgtcactagagaaggccgctaatgtgcagtgggatgaaatggcagacataacaggctcaagtccaatcatagaagtgaagcaagatgaggatggctctttctccatacgggacgtcgaggaaaccaatatgataacccttttggtgaagctggcactgataacagtgtcaggtctctaccctttggcaattccagtcacaatgaccttatggtacatgtggcaagtgaaaacacaaagatcaggagccctgtgggacgtcccctcacccgctgccactcaaaaagccgcactgtctgaaggagtgtacaggatcatgcaaagagggttattcgggaaaactcaggttggagtagggatacacatggaaggtgtatttcacacaatgtggcatgttacaagaggatcagtgatctgccacgagactgggagattggagccatcttgggctgacgtcaggaatgacatgatatcatacggtgggggatggaggcttggagacaaatgggacaaagaagaagacgttcaggtcctcgctatagaaccaggaaaaaatcccaaacatgtccaaacgaaacctggccttttcaagaccctaactggagaaattggagcagtaacattagatttcaaacccggaacgtctggttctcccattatcaacaggaaaggaaaagtcatcggactctatggaaatggagtggtcaccaaatcaggtgattacgtcagtgctataacgcaagccgaaagaattggagagccagattatgaggtggatgaggatatttttcgaaagaaaagattaactataatggacttacaccccggagctggaaagacaaaaagaattcttccatcaatagtgagggaagccttaaaaaggaggctgcgaactttgattctggctcccacgagagtggtggcggccgagatggaagaggccctacgtggactgccaatccgttaccagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttccagtgtcgcggctagaggatacatttcgaccagggtggaaatgggagaggcagcagccatcttcatgaccgcaacccctcccggagcgacagatccctttccccagagcaacagcccaatagaagacatcgagagagagattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagaatatccaaaaacgaaactcacggattgggactttgtggtcactacagacatatctgaaatgggggctaattttagagctgggagagtgatagaccctagaagatgcctcaagccagttatcctaacagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcatctgctggcatttcttacaaagatcgggaatggtgcttcactggggaaagaaataaccaaattttagaagaaaacatggaggttgaaatttggactagagagggagaaaagaaaaaactaaggccaagatggttagatgcacgtgtatacgctgaccccatggctttgaaggatttcaaggagtttgccagtggaaggaagagtataactctcgacatcctaacagagattgccagcttgccaacttacctttcctctagggccaagctcgcccttgacaacatagtcatgctccacacaacagaaagaggagggagggcctatcaacacgccctgaacgaacttccggagtcactggaaacactcatgcttgtagccttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcttcaatcatactggagttttttctcatggtactgttgataccagaaccagaaaaacaaaggaccccacaagacaatcaattgatctacgtcatattgaccattctcaccattattggtctaatagcagccaacgagatggggctgatagaaaaaacaaaaacggattttgggttttaccaggtaaaaacagaaaccaccatcctcgatgtggacttgagaccagcttcagcatggacgctctatgcggtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccctgacagcatccttagtcatgcttttagtccattatgcaataataggcccaggattgcaggcaaaagccacaagagaggcccagaaaaggacagctgctggaatcatgaaaaatcccacagtggacgggataacagtaatagatctagaaccaatatcctatgacccaaaatttgaaaaacaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaaaccaaaagggaaagttgtagatcttggctgtgggagaggaggatggtcttattacatggcgacactcaagaacgtgactgaagtgaaagggtatacaaaaggaggtccaggacatgaagaaccgattcccatggctacctatggctggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatctcggggcaggaacgagaagtgtctctactgaaacagaaaaaccagacatgacaatcattgggagaaggcttcagcgattgcaagaagagcacaaagaaacatggcattatgatcaggaaaacccatacagaacctgggcgtatcatggaagctatgaagctccttcgacaggctctgcatcctccatggtgaacggggtggtgaaactgctaacaaaaccctgggatgtgattccaatggtgactcagttagccatgacagatacaaccccttttgggcaacaaagagtgttcaaagagaaggtggataccagaacaccgcaaccaaaaccaggcacacgaatggttatgaccacgacagccaattggctatgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggcccttcaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatacatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagctattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgagagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctctcaccactttcacaagatctttatgaaggatggccgctcactagttgttccatgtagaaaccaggatgaactgatagggagagccagaatctcgcagggggctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccaatggatgaccactgaagacatgctcaaagtgtggaacagagtgtggatagaagacaaccccaatatgattgacaagaccccagtccattcgtgggaagatataccttacctagggaaaagagaggatttgtggtgtggatccctgattggactttcttctagagccacctgggcgaagaacattcacacggccataactcaggtcaggaacctgatcggaaaagaggaatacgtggattacatgccagtaatgaaaagatacagtgctccttcagagagtgaaggagttctgtaa

SEQ ID NO: 1659 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgtggcgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgctttttgtccattatgcaataataggcccaggattgcaggcaaaagccacaagagaggcccagaaaaggacagctgctgggatcatgaaaaatcccacagtggacgggataacagtaatagatctagaaccaatatcttatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatcaagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgcggggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1660 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcaaggaacacttcaatggctatgacgtgcatagctgttggaggaatcactctgtttctgggcttcacagttcaagcagacatgggttgtgtggtgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagccatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggagacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1661 - DNA, 10164 bp, Dengue virus
atgaaccaacgaaaaagggtggttagaccacctttcaatatgctgaaacgcgagagaaaccgcgtatcaacccctcaagggttggtgaagagattctcaaccggacttttttccggaaaaggacccttacggatggtgttagcattcatcacgttcttgcgagtcctttccatcccaccaacagcagggattctgaaaagatggggacagttgaagaaaaacaaggccatcaaaatactgactggattcaggaaggagataggccgcatgctgaacatcttgaatggaaggaaaaggtcaacaatgacattgctgtgcttgattcccaccgtaatggcgtttcacttgtcaacaagagatggcgaacccctcatgatagtgggaaaacacgaaagggggagacctctcttgtttaagacaacagagggaatcaacaaatgcactcttattgccatggacctgggtgaaatgtgtgaggacaccgtcacgtacaaatgccccctactggtcaataccgaacctgaggacattgactgctggtgcaatctcacgtctgcctgggtcatgtatggaacatgtactcagagtggggaacggagacgggagaagcgctcagtagccctaacaccacattcaggaatgggattggagacaagggctgagacatggatgtcatcggaaggggcttggaaacatgctcagagggtagagagttgggtactcaggaacccaggattcgctctcttggcaggatttatggcctatatgattgggcagacaggaatccaacgagcagtcttctttgttctaatgatgctggtcgctccatcctacggaatgcgatgcgtgggagtggggaacagagactttgtggaaggagtctcaggtggagcatgggtcgatttagtgctagaacatggaggatgtgtcacaaccatggcccagggaaaaccaaccttggattttgaactgatcaagacaacagccaaggaagtggctctgttaagaacctattgcattgaagcctcgatatcaaacataaccacggcaacaagatgcccaacgcaaggagaaccttatctcaaagaggaacaagatcaacagtacatctgccggagagatgtggtagacagagggtggggcaatggctgtggcttgtttgggaaaggaggagttgtgacatgtgcgaagttctcatgctcgggaaagataacaggcaatttggtccaaattgagaaccttgaatacacagtggttgtaacagtccacaatggagacacccatgcagtaggaaatgatacatccaaccatggagttacagccacgataacccccaggtcaccatcggtagaagttaaattaccggattatggagaattgacacttgattgtgaacccaggtccggaattgacttcaatgagatgattctgatgaaaatgaaaaagaaaacgtggcttgtgcacaagcaatggtttttggatctacctctaccatgggcagcaggagcagatacatcagaagttcattggaattacaaagagagaatggtaacattcaaggttcctcatgccaagagacaggatgtgacagtgctaggatctcaggaaggagccatgcattctgccctcaccggagctacagaagtggattccggtgatggaaaccacatgtttgcaggacatctgaaatgcaaagttcgcatggagaaattgagaattaagggaatgtcatacacgatgtgctcaggaaagttctcaattgacaaagagatggcagaaacacagcatgggacaacagtgattaaagtcaaatatgaaggtgctggagctccgtgtaaagttcccatagagataagagatgtgaacaaggaaaaagtggtagggcgtgtcatctcatctaccccttttgctgagaataccaacagtgtaaccaacatagagttggaacccccttttggggacagctacataataataggtgttggagacagtgcattaacactccattggttcaggaaagggagttccattggcaagatgtttgagtccacatacagaggtgcaaagcgaatggccattctaggtgaaacagcctgggattttggttctgttggtggattgctcacatcattgggaaaggctgtacaccaggtttttggtagtgtgtatacaactatgtttggaggagtctcatggatggttagaatcctaattgggttcctagtgttgtggattggcacgaattcgagaaacacctcaatggcaatgacgtgcatagctgttggaggaatcactctgtttctaggtttcacagttcaagcagacacgggttgtgcggtgtcatggagtggaaaagaattgaaatgtggaagcggaatctttgtaattgacaatgtgcacacttggacagagcagcacaaatttcaaccagagtctccagcgagactagcgtctgcaatattgaatgcccacaaagacggggtctgtggaattagatcaaccacgaggctggaaaacatcatgtggaagcaaataaccaacgagttgaactatgttctttgggaaggaggacatgacctcactgtagtggccggggatgtgaaaggggtgctgtccaaaggcaagagagcacttgcacccccagtgaatgatctgaaatattcatggaagacatggggaaaagcaaaaatctttactccagaaacaaaaaatagcacatttctaatagacggaccagacacctccgaatgccccaatgaacggagagcatggaattttctcgaggtagaagactatggatttggcatgttcacgaccaacatatggatgaaatttcgagaaggaagttcagaagtgtgtgaccacaggttgatgtcggcggcaatcaaggaccagaaagctgtgcatgctgatatgggatattggatagagagctcaaaaaaccagacctggcagatagagagagcatctctcattgaagtgaaaacatgtctatggcccaagacccacacattgtggagcaatggagtgctagagagccagatgctcattccaaaagcatatgcaggccctttttcacagcacaattaccgccagggctatgccacgcagaccgtgggcccatggcacttgggcaaactagaaatagactttggagaatgccccggaacaacagtcactgtccaggaggattgtgaccatagaggcccatctttgaggaccaccactgcatctggaaaattggtcacgcagtggtgctgccgctcctgcacgatgccccccttaaggtttttgggagaggatggatgctggtatgggatggaaatcagacccttgagtgaaaaagaagagaacatggtcaaatcacaggtatcggccggtcagggtacaccagaaactttttctatggggctgttatgcctgactttgtttgtggaagaatgcttgaggagaagagtcaccaggaaacacatgatattggttgtggtggccaccctttgtgccatcatcctaggaggtctcacatggatggacttactacgagccctcatcatgttaggggacaccatgtctggtagaatgggaggtcagattcacttagccatcatgacaatgttcaagatgtcaccaggatacgtgttgggtatatttttaaggagactcacttcaagagagacagcactaatggtgataggaatggccatgacaacagtgttttcaattccacgtgaccttatggaattcattgatggactatcactggggttaatcttgttaaaaatggtaacacattttgacaacactcaagtgggaaccttagctctttctttgactttcataagatcaacaatgccattggtcatggcttggaggaccataatggctgtgttatttgtggtcacactcattcctttatgcaggacaagctgtctccaaaaccagtcacattgggtagaaataacagcactcatcctgggagcccaggctctgccagtgtacctaatgactctcatgaaaggagcctcaaaaagatcctggccccttaacgagggtataatggctgtgggtctggtcagtctcttgggaagcgccctcctaaagaatgatgtccccttggctggcccaatggtggcaggaggcttacttctggcagcctatgtgatgagtggtagtgcagcagacctgtcactagagaaggccgccaatgtgcagtgggatgagatggcagacataacaggctcaagcccaatcatagaagtgaagcaggatgaagatggctctttctccatacgggacatcgaggaaaccaatatgataaccctcttggtgaaactggcactgataacagtgtcaggtctctaccccttggcaattccagtcacaatggccctatggtacatgtggcaggtgaaaacacaaagatcaggagccttgtgggacgtcccctcacctgctgccgctcagaaagccacactgactgaaggagtgtaccggatcatgcagagagggttgtttgggaaaactcaggttggagtagggatacacatggaaggtgtgtttcacacaatgtggcatgtaacaagaggatcagtgatctgccatgagactgggagactggagccatcttgggctgatgtcaggaacgacatgatatcatacggtgggggatggaggctcggagacaaatgggacaaagaagaagatgttcaggttctagctatagaaccaggaaaaaacccgaagcacgtccaaacgaagcccggtcttttcaaaaccctaactggagaaattggagcagtgacattggattttaaacctggaacgtctggttctcccatcattaacaggaaaggaaaagtcatcggactctacggaaatggagtggtcactaaatcaggtgattacgttagtgccataacgcaagccgaaagaactggtgagccagattatgaagtggatgaggacatttttcgaaagaaaagactaactataatggacctacaccccggagccggaaagacaaaaagaattctcccatcaatagtcagagaagccttaaaaaggaggctgcggaccttgattttggctcccacgagagtggtggcggccgagatggaagaggccctacgtggactgccaatccgttatcagactccagctgtgaaatcagagcacacaggaagagagatcgtggacctcatgtgtcatgcaaccttcacaacaagacttttatcatcaaccagggttccaaattacaacctcatagtgatggatgaagcacatttcacagacccttctagtgtcgcggctagaggatacatctcaaccagggtggaaatgggagaggcagcagccatctttatgactgcgactcctcctggagccacagatccctttccccagagcaacagcccaatagaagacatcgagagagaaattccagaaaggtcatggaacacagggttcgactggataaccgactaccaagggaaaactgtgtggtttgttcccagcataaaagctggcaatgatattgcaaactgcttgagaaagtcgggaaagaaggtgatccaattgagtagaaaaacctttgacacagagtatccaaaaacgaaactcacagactgggattttgtggttaccacagacatatcagaaatgggggccaattttagagctgggagagtgatagaccccaggagatgtctcaagccagttattttaactgacgggccagagagagttattttggcaggtcccattccagtgactccagcaagcgctgctcagagaagagggcgaataggtaggaaccctacacaagaagatgaccaatatgtcttctccggagacccactaaaaaatgacgaagatcatgcccactggacagaagcaaagatgctgcttgataatatctacaccccagaagggatcattccaacattgtttggtccggaaagagaaaaaagtcaagccattgatggagagttccgcctcagaggggaacaaaggaagacttttgtagaattaatgaggagaggagacctcccggtgtggctgagctataaggtagcttctgctggtatctcttacaaagaccgggaatggtgcttcacaggggaaaggaataaccaaattctagaagaaaacatggaggttgaaatttggactagagagggagagaagaaaaaactcaggccaaaatggttagatgcgcgtgtttacgctgaccccatggctttgaaggatttcaaggagtttgccagtggaagaaagagcataaccctcgacatcctaacagagattgccagtttgccaacttacctttcttctagagctaagctcgcccttgacaacatagtcatgctccacacaacagaaagaggagggaaggcctaccaacatgccttgaacgaactcccggagtcactagaaacactcatgcttgtagctctactgggtgctatgacagcaggcatcttcttgtttttcatgcaagggaaaggaatagggaaactgtcaatgggtttgatagccattgcggtagctagcggcttgctctgggtagcagaaatccagccccagtggatagcggcttcaatcatactagagttctttctcatggtgttgttgataccagaaccagaaaaacaaaggaccccacaagacaatcaattgatctacgtcatattgaccattctcaccatcattggtctcatagcagccaacgagatgggactgattgaaaaaacaaaaacggattttgggttttaccaggtgaaaacagaaatcaccatccttgatgtggatttgagaccagcctcagcgtggacgctctatgcagtagccaccactattctgactcccatgctgagacacaccatagaaaacacgtctgcaaacctatctctagcggccattgctaaccatgcagctgtcctaatggggcttggaaaaggatggccgctccacaggatggacctcggcgtgccgctgttggcaatgggatgctattctcaagtgaacccaacgaccttgacagcatccttagtcatgcttttagtccattacgcaataataggtccaggactgcaggcaaaagccacaagagaggctcagaaaagaacagcagctgggatcatgaagaaccccaccgtggacgggataacagtaatagatctagaaccaatatcctatgacccaaagtttgaaaagcaattggggcaagtcatgctactagtcttgtgtgctggacagctactcttgatgagaacaacatgggctttctgtgaagtcttgactttggccacaggaccagtcctgaccctgtgggagggtaacccgggaaggttttggaacacgactatagccgtgtccactgccaacattttcagaggaagctacttggcgggagctggactggccttttcgcttataaagaatgcacaaacccccaggagaggaactggtaccacaggagagacactgggagaaaagtggaagagacagctaaactcactagataggaaggagtttgaagagtacaaaagaagtggcatactagaagtggacaggactgaagctaagtctgccttgaaagatggatctaaaatcaagcacgcagtatctagagggtccagtaagattagatggattgttgaaagagggatggtaaaaccaaaaggaaaagttgtggatcttggttgcgggagaggaggatggtcgtattacatggcaacactcaagaacgtaaccgaagtgaaagggtacacaaaaggaggtccaggacatgaagaaccgattcccatggctacctatggctggaacttggtcaaactccattcaggggttgatgtgttctacaaacccactgagcaagtggataccctgctctgtgatattggggagtcatcttccaatccgacgatagaggaaggaagaacattaagagttttgaagatggtggaaccatggctctcttcaaagcctgaattttgcatcaaagtccttaatccctatatgccaacagtcatagaagagctagagaaactgcagagaaaatatggtggaagtcttgtcagatgcccgttatctaggaattccactcatgagatgtattgggtgtcaggtgtgtcgggaaacatcgtgagctctgtaaacacaacatcaaaaatgttgttgaacagatttacaacaaggcatagaaaacccacttatgagaaggacgtagaccttggagcaggaacgagaagtgtctccactgaaacagaaaaaccggacatgacaatcatcgggagaaggctccagcgactgcaagaagagcacaaagaaacctggcactatgatcaggaaaacccatacagaacctgggcgtatcatggaagctatgaagctccctcgacaggctcagcatcctccatggtgaacggggtggtaaaattgctgacaaaaccctgggacgtgattccaatggtgacccagttggctatgacagacacaaccccttttgggcaacagagagtgtttaaagagaaggtggacaccagaacaccacaaccaaagcctggcacacgaatggtcatgaccacgacagccaattggctgtgggctctcctcgggaagaagaaaaaacccagactgtgtacaagggaagagttcatctcaaaagttaggtcaaatgcagccataggcgcagtctttcaggaagaacagggatggacatcagccagtgaagctgtgaatgacagccgattttgggaactggttgacaaagaaaggactctgcaccaggaagggaaatgtgaatcgtgtgtctacaacatgatgggaaaacgtgagaaaaagttaggagagtttggtagagccaagggaagccgagcaatctggtacatgtggctaggagcgcggtttctggaatttgaagccctgggttttttgaatgaagatcattggtttggcagagaaaactcatggagtggagtggaaggggaaggcctgcacagattgggatatatcctggaggacattgacaagaaggatggagacctgatatatgctgatgatacagctggttgggacacaagaatcactgaagatgaccttctaaatgaagaactgatcacggaacagatggcccctcaccataagatcctagccaaagctattttcaaactaacttatcaaaacaaagtggtgaaagtcctcagacccacaccgaaaggagcggtgatggacataatatccaggaaagaccaaagaggtagtggacaggtcggaacatatggtttgaacacattcactaacatggaagtacaactcatccgccaaatggaagctgaaggagtcatcacacaagatgacatgcacaacccaaaagggttgaaagaaagagttgagaaatggctgaaagagtgtggtgtcgataggttgaaaaggatggcaatcagtggagacgattgtgtggtgaagcctctggatgaaaggttcagcacttctctcctctttttgaacgacatgggaaaggtgaggaaagacattccgcagtgggaaccatctaagggatggaaaaactggcaagaggtccctttttgctcccaccactttcacaagatcttcatgaaggatggccgctcactcgtagttccatgtagaaaccaggatgaactgatagggagagccagaatctcgcaaggggctggatggagtttaagagaaacagcttgcctgggcaaagcttacgcccagatgtggtcactcatgtactttcacagaagggacctgcgtttagcctccatggcgatatgctcagcagttccaacagaatggtttccaacaagcagaacaacatggtcaatccacgcccatcatcagtggatgactactgaagatatgctcaaagtgtggaacagagtgtggatagaagacaaccccaatatgactgacaagactccagttcattcgtgggaagacataccttacctaggaaaaagagaagacttgtggtgtggatccttgattggactttcctccagggccacctgggcgaagaacatacacacagccataacccaggtcaggaacctgatcggaaaagaggagtatgtggattacatgccagtcatgaaaagatacagcgctcccttcgagagtgaaggagttctgtaa

SEQ ID NO: 1662 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccctcagcacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgtggcgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatcaagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgcggggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1663 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttttctgggaaaggacccttacggatggtgctagcattcatcacgtttttgcgagtcctttccatcccaccaacagcagggattctgaagagatggggacagttgaagaaaaataaggccatcaagatactgattggattcaggaaggagataggccgcatgctgaacatcttgaacgggagaaaaaggtcaacgataacattgctgtgcttgattcccaccgtaatggcgttttccttgtcaacaagagatggcgaacccctcatgatagtggcaaaacatgaaagggggagacctctcttgtttaagacaacagaggggatcaacaaatgcactctcattgccatggacttgggtgaaatgtgtgaggacactgtcacgtataaatgccccctactggtcaataccgaacctgaagacattgattgctggtgcaacctcacgtctacctgggtcatgtatgggacatgcacccagagcggagaacggagacgagagaagcgctcagtagctttaacaccacattcaggaatgggattggaaacaagagctgagacatggatgtcatcggaaggggcttggaagcatgctcagagagtagagagctggatactcagaaacccaggattcgcgctcttggcaggatttatggcttatatgattgggcaaacaggaatccagcgaactgtcttctttgtcctaatgatgctggtcgccccatcctacggaatgcgatgcgtaggagtaggaaacagagactttgtggaaggagtctcaggtggagcatgggtcgacctggtgctagaacatggaggatgcgtcacaaccatggcccagggaaaaccaaccttggattttgaactgactaagacaacagccaaggaagtggctctgttaagaacctattgcattgaagcctcaatatcaaacataactacggcaacaagatgtccaacgcaaggagagccttatctgaaagaggaacaggaccaacagtacatttgccggagagatgtggtagacagagggtggggcaatggctgtggcttgtttggaaaaggaggagttgtgacatgtgcgaagttttcatgttcggggaagataacaggcaatttggtccaaattgagaaccttgaatacacagtggttgtaacagtccacaatggagacacccatgcagtaggaaatgacacatccaatcatggagttacagccatgataactcccaggtcaccatcggtggaagtcaaattgccggactatggagaactaacactcgattgtgaacccaggtctggaattgactttaatgagatgattctgatgaaaatgaaaaagaaaacatggctcgtgcataagcaatggtttttggatctgcctcttccatggacagcaggagcagacacatcagaggttcactggaattacaaagagagaatggtgacatttaaggttcctcatgccaagagacaggatgtgacagtgctgggatctcaggaaggagccatgcattctgccctcgctggagccacagaagtggactccggtgatggaaatcacatgtttgcaggacatcttaagtgcaaagtccgtatggagaaattgagaatcaagggaatgtcatacacgatgtgttcaggaaagttttcaattgacaaagagatggcagaaacacagcatgggacaacagtggtgaaagtcaagtatgaaggtgctggagctccgtgtaaagtccccatagagataagagatgtaaacaaggaaaaagtggttgggcgtatcatctcatccacccctttggctgagaataccaacagtgtaaccaacatagaattagaacccccctttggggacagctacatagtgataggtgttggaaacagcgcattaacactccattggttcaggaaagggagttccattggcaagatgtttgagtccacatacagaggtgcaaaacgaatggccattctaggtgaaacagcttgggattttggttccgttggtggactgttcacatcattgggaaaggctgtgcaccaggtttttggaagtgtgtatacaaccatgtttggaggagtctcatggatgattagaatcctaattgggttcttagtgttgtggattggcacgaactcgaggaacacttcaatggctatgacgtgcatagctgttggaggaatcactctgtttctgggcttcacagttcaagcagacatgggttgtgtggcgtcatggagtgggaaagaattgaagtgtggaagcggaatttttgtggttgacaacgtgcacacttggacagaacagtacaaatttcaaccagagtccccagcgagactagcgtctgcaatattaaatgcccacaaagatggggtctgtggaattagatcaaccacgaggctggaaaatgtcatgtggaagcaaataaccaacgagctaaactatgttctctgggaaggaggacatgacctcactgtagtggctggggatgtgaagggggtgttgaccaaaggcaagagagcactcacacccccagtgagtgatctgaaatattcatggaagacatggggaaaagcaaaaatcttcaccccagaagcaagaaatagcacatttttaatagacggaccagacacctctgaatgccccaatgaacgaagagcatggaactctcttgaggtggaagactatggatttggcatgttcacgaccaacatatggatgaaattccgagaaggaagttcagaagtgtgtgaccacaggttaatgtcagctgcaattaaagatcagaaagctgtgcatgctgacatgggttattggatagagagctcaaaaaaccagacctggcagatagagaaagcatctcttattgaagtgaaaacatgtctgtggcccaagacccacacactgtggagcaatggagtgctggaaagccagatgctcattccaaaatcatatgcgggccctttttcacagcacaattaccgccagggctatgccacgcaaaccgtgggcccatggcacttaggcaaattagagatagactttggagaatgccccggaacaacagtcacaattcaggaggattgtgaccatagaggcccatctttgaggaccaccactgcatctggaaaactagtcacgcaatggtgctgccgctcctgcacgatgcctcccttaaggttcttgggagaagatgggtgctggtatgggatggagattaggcccttgagtgaaaaagaagagaacatggtcaaatcacaggtgacggccggacagggcacatcagaaactttttctatgggtctgttgtgcctgaccttgtttgtggaagaatgcttgaggagaagagtcactaggaaacacatgatattagttgtggtgatcactctttgtgctatcatcctgggaggcctcacatggatggacttactacgagccctcatcatgttgggggacactatgtctggtagaataggaggacagatccacctagccatcatggcagtgttcaagatgtcaccaggatacgtgctgggtgtgtttttaaggaaactcacttcaagagagacagcactaatggtaataggaatggccatgacaacggtgctttcaattccacatgaccttatggaactcattgatggaatatcactgggactaattttgctaaaaatagtaacacagtttgacaacacccaagtgggaaccttagctctttccttgactttcataagatcaacaatgccattggtcatggcttggaggaccattatggctgtgttgtttgtggtcacactcattcctttgtgcaggacaagctgtcttcaaaaacagtctcattgggtagaaataacagcactcatcctaggagcccaagctctgccagtgtacctaatgactcttatgaaaggagcctcaagaagatcttggcctcttaacgagggcataatggctgtgggtttggttagtctcttaggaagcgctcttttaaagaatgatgtccctttagctggcccaatggtggcaggaggcttacttctggcggcttacgtgatgagtggtagctcagcagatctgtcactagagaaggccgccaacgtgcagtgggatgaaatggcagacataacaggctcaagcccaatcatagaagtgaagcaggatgaagatggctctttctccatacgggacgtcgaggaaaccaatatgataacccttttggtgaaactggcactgataacagtgtcaggtctctaccccttggcaattccagtcacaatgaccttatggtacatgtggcaagtgaaaacacaaagatcaggagccctgtgggacgtcccctcacccgctgccactaaaaaagccgcactgtctgaaggagtgtacaggatcatgcaaagagggttattcgggaaaactcaggttggagtagggatacacatggaaggtgtatttcacacaatgtggcatgtaacaagaggatcagtgatctgccacgagactgggagattggagccatcttgggctgacgtcaggaatgacatgatatcatacggtgggggatggaggcttggagacaaatgggacaaagaagaagacgttcaggtcctcgccatagaaccaggaaaaaatcctaaacatgtccaaacgaaacctggccttttcaagaccctaactggagaaattggagcagtaacattagatttcaaacccggaacgtctggttctcccatcatcaacaggaaaggaaaagtcatcggactctatggaaatggagtagttaccaaatcaggtgattacgtcagtgccataacgcaagccgaaagaattggagagccagattatgaagtggatgaggacatttttcgaaagaaaagattaactataatggacttacaccccggagctggaaagacaaaaagaattcttccatcaatagtgagagaagccttaaaaaggaggctacgaactttgattttagctcccacgagagtggtggcggccgagatggaagaggccctacgtggactgccaatccgttatcagaccccagctgtgaaatcagaacacacaggaagagagattgtagacctcatgtgtcatgcaaccttcacaacaagacttttgtcatcaaccagggttccaaattacaaccttatagtgatggatgaagcacatttcaccgatccttctagtgtcgcggctagaggatacatctcgaccagggtggaaatgggagaggcagcagccatcttcatgaccgcaacccctcccggagcgacagatccctttccccagagcaacagcccaatagaagacatcgagagggaaattccggaaaggtcatggaacacagggttcgactggataacagactaccaagggaaaactgtgtggtttgttcccagcataaaagctggaaatgacattgcaaattgtttgagaaagtcgggaaagaaagttatccagttgagtaggaaaacctttgatacagagtatccaaaaacgaaactcacggactgggactttgtggtcactacagacatatctgaaatgggggccaattttagagccgggagagtgatagaccctagaagatgcctcaagccagttatcctaccagatgggccagagagagtcattttagcaggtcctattccagtgactccagcaagcgctgctcagagaagagggcgaataggaaggaacccagcacaagaagacgaccaatacgttttctccggagacccactaaaaaatgatgaagatcatgcccactggacagaagcaaagatgctgcttgacaatatctacaccccagaagggatcattccaacattgtttggtccggaaagggaaaaaacccaagccattgatggagagtttcgcctcagaggggaacaaaggaagacttttgtggaattaatgaggagaggagaccttccggtgtggctgagctataaggtagcttctgctggcatttcttacaaagatcgggaatggtgcttcacaggggaaagaaataaccaaattttagaagaaaacatggaggttgaaatttggactagagagggagaaaagaaaaagctaaggccaagatggttagatgcacgtgtatacgctgaccccatggctttgaaggatttcaaggagtttgccagtggaaggaagagtataactctcgacatcctaacagagattgccagtttgccaacttacctttcctctagggccaagctcgcccttgataacatagtcatgctccacacaacagaaagaggagggagggcctatcaacacgccctgaacgaacttccggagtcactggaaacactcatgcttgtagctttactaggtgctatgacagcaggcatcttcctgtttttcatgcaagggaaaggaatagggaaattgtcaatgggtttgataaccattgcggtggctagtggcttgctctgggtagcagaaattcaaccccagtggatagcggcctcaatcatactagagttttttctcatggtactgttgataccggaaccagaaaaacaaaggaccccacaagacaatcaattgatctacgtcatattgaccattctcaccatcattggtctaatagcagccaacgagatggggctgattgaaaaaacaaaaacggattttgggttttaccaggtaaaaacagaaaccaccatcctcgatgtggacttgagaccagcttcagcatggacgctctatgcagtagccaccacaattctgactcccatgctgagacacaccatagaaaacacgtcggccaacctatctctagcagccattgccaaccaggcagccgtcctaatggggcttggaaaaggatggccgctccacagaatggacctcggtgtgccgctgttagcaatgggatgctattctcaagtgaacccaacaaccttgacagcatccttagtcatgcttttagtccattatgcaataataggcccaggattgcaggcaaaagccacaagagaggcccagaaaaggacagctgctgggatcatgaaaaatcccacagtggacgggataacagtaatagatctagaaccaatatcctatgacccaaaatttgaaaagcaattagggcaggtcatgctactagtcttgtgtgctggacaactactcttgatgagaacaacatgggctttctgtgaagtcttgactttggccacaggaccaatcttgaccttgtgggagggcaacccgggaaggttttggaacacgaccatagccgtatccaccgccaacattttcaggggaagttacttggcgggagctggactggctttttcactcataaagaatgcacaaacccctaggaggggaactgggaccacaggagagacactgggagagaagtggaagagacagctaaactcattagacagaaaagagtttgaagagtataaaagaagtggaatactagaagtggacaggactgaagccaagtctgccctgaaagatgggtctaaaatcaagcatgcagtatctagagggtccagtaagatcagatggattgttgagagagggatggtaaagccaaaagggaaagttgtagatcttggctgtgggagaggaggatggtcttattacatggcgacactcaagaacgtgactgaagtgaaagggtatacaaaaggaggtccaggacatgaagaaccgattcccatggctacttatggttggaatttggtcaaactccattcaggggttgacgtgttctacaaacccacagagcaagtggacaccctgctctgtgatattggggagtcatcttctaatccaacaatagaggaaggaagaacattaagagttttgaagatggtggagccatggctctcttcaaaacctgaattctgcatcaaagtccttaacccctacatgccaacagtcatagaagagctggagaaactgcagagaaaacatggtgggaaccttgtcagatgcccgctgtccaggaactccacccatgagatgtattgggtgtcaggagcgtcgggaaacattgtgagctctgtgaacacaacatcaaagatgttgttgaacaggttcacaacaaggcataggaaacccacttatgagaaggacgtagatcttggggcaggaacgagaagtgtctccactgaaacagaaaaaccagacatgacaatcattgggagaaggcttcagcgattgcaagaagagcacaaagaaacctggcattatgatcaggaaaacccatacagaacctgggcgtatcatggaagctatgaagctccttcgacaggctctgcatcctccatggtgaacggggtggtaaaactgctaacaaaaccctgggatgtgattccaatggtgactcagttagccatgacagatacaaccccttttgggcaacaaagagtgttcaaagagaaggtggataccagaacaccacaaccaaaacccggtacacgaatggttatgaccacgacagccaattggctgtgggccctccttggaaagaagaaaaatcccagactgtgcacaagggaagagttcatctcaaaagttagatcaaacgcagccataggcgcagtctttcaggaagaacagggatggacatcagccagtgaagctgtgaatgacagccggttttgggaactggttgacaaagaaagggccctacaccaggaagggaaatgtgaatcgtgtgtctataacatgatgggaaaacgtgagaaaaagttaggagagtttggcagagccaagggaagccgagcaatctggtacatgtggctgggagcgcggtttctggaatttgaagccctgggttttttgaatgaagatcactggtttggcagagaaaattcatggagtggagtggaaggggaaggtctgcacagattgggatatatcctggaggagatagacaagaaggatggagacctaatgtatgctgatgacacagcaggctgggacacaagaatcactgaggatgaccttcaaaatgaggaactgatcacggaacagatggctccccaccacaagatcctagccaaagccattttcaaactaacctatcaaaacaaagtggtgaaagtcctcagacccacaccgagaggagcggtgatggatatcatatccaggaaagaccaaagaggtagtggacaagttggaacatatggtttgaacacattcaccaacatggaagttcaactcatccgccaaatggaagctgaaggagtcatcacacaagatgacatgcagaacccaaaagggttgaaagaaagagttgagaaatggctgaaagagtgtggtgtcgacaggttaaagaggatggcaatcagtggagacgattgcgtggtgaagcccctagatgagaggtttggcacttccctcctcttcttgaacgacatgggaaaggtgaggaaagacattccgcagtgggaaccatctaagggatggaaaaactggcaagaggttcctttttgctcccaccactttcacaagatctttatgaaggatggccgctcactagttgttccatgtagaaaccaggatgaactgatagggagagccagaatctcgcagggagctggatggagcttaagagaaacagcctgcctgggcaaagcttacgcccagatgtggtcgcttatgtacttccacagaagggatctgcgtttagcctccatggccatatgctcagcagttccaacggaatggtttccaacaagcagaacaacatggtcaatccacgctcatcaccagtggatgaccactgaagatatgctcaaagtgtggaacagagtgtggatagaagacaaccctaatatgactgacaagactccagtccattcgtgggaagatataccttacctagggaaaagagaggatttgtggtgtggatccctgattggactttcttccagagccacctgggcgaagaacattcacacggccataacccaggtcaggaacctgatcggaaaagaggaatacgtggattacatgccagtaatgaaaagatacagtgctccttcagagagtgaaggagttctgtaa

SEQ ID NO: 1664 - DNA, 213 bp, Dengue virus
atgctgaaacgcgagagaaaccgcgtatcaacccctcaagggttggtgaagagattctcaaccggacttttctccgggaaaggacccttacggatggtgctagcattcatcacgtttttgcgagttctttccatcccgccaacagcagggattctgaaaagatggggacagttgaaaaagaataaggccatcaagacactgattggattcagg

SEQ ID NO: 1665 - DNA, 10164 bp, Dengue virus
atgaaccaacgaaaaaaggtggttagaccacctttcaatatgctgaaacgcgagagaaaccgcgtatcaacccctcaagggttggtgaagagattctcaaccggacttttctccgggaaaggacccttacggatggtgctagcattcatcacgtttttgcgagtcctttccatcccgccaacagcagggattctgaaaagatggggacagttgaaaaagaataaggccatcaagatactgattggattcaggaaggagataggtcgcatgttaaacatcttgaataggagaagaaggtcaacagtgacattgctgtgtttgattcccaccgtaatggcgtttcacctgtcaacaagagacggcgaacccctcatgatagtggcaaaacacgaaagggggagacctctcttgtttaagacaacagaaggaatcaacaaatgcaccctcattgccatggacctgggtgaaatgtgtgaagacactgtcacgtataaatgtcctctactggttaacaccgaacctgaagacattgattgctggtgcaatctcacgtccacctgggtcatgtacgggacatgcacccagagcggagaacggaggcgagagaagcgctcagtagctttaacaccacattcaggaatgggattggaaacaagagctgagacatggatgtcatcggaaggggcttggaaacatgctcagagagtggaaagctggatactcagaaacccaggattcgcgcttctggcaggatttatggcttacatgattgggcaaacaggaattcagcgaactgttttctttgtcctaatgatgctagtcgccccatcctacggaatgcgatgcgtaggggtagggaacagagactttgtggaaggagtctcgggtggagcatgggtcgacctggtgctagaacatggaggatgtgtcacaaccatggcccagggaaaaccaaccttggattttgaactgaccaagacaacagctaaggaagtggctctgttaagaacctattgcattgaagcttcgatatcaaacataaccacggcaacaagatgtccaacgcaaggagagccttatctcaaagaggaacaagaccaacagtacatttgccggagagacgtggtagacagagggtggggcaatggctgtggcttgtttggaaaaggaggagttgtgacatgtgcgaagtttttatgctcggggaagataacaggcaatctggtccaaattgaaaaccttgaatatacggtagttgtgacagtccacaatggagacacccatgcagtaggaaatgacacatccaatcatggagtgacagctacgataactcccaggtcaccatcggtagaagttaaattgccggactatggggaactaacactcgattgtgaacccaggtccggaattgatttcaatgagatgattctgatgagaatgaaaaagaaaacgtggcttgtgcacaagcaatggtttttggacctacctctaccatggacagcaggagcagacacatcagaagttcattggaattataaagagagaatggtgacattcaaagttcctcatgccaagagacaggatgtgacagtgctaggatctcaggagggagctatgcattctgccctcgccggagccacagaagtggattctggcgatggaaatcacatgtttgcaggacatctcaagtgcaaagttcgtatggagaaattgagaattaagggaatgtcatacacgatgtgttcaggaaagttctcaattgacaaagagatggcagaaacacagcatgggacaacagtagtgaaagtcaagtatgaaggcgctggagctccgtgcaaagtccccatagagataagagatgtgaacaaggaaaaagtagttgggcgcatcatctcatccaccccttttgctgagagtaccaacagcgtaaccaacatagaattagaacccccttttggggacagctatatagtgataggtgttggagacagtgcattaacactccattggttcaggaaagggagctccattggcaagatgtttgagtccacatacagaggtgcaaaacgaatggccattctaggtgaaacagcctgggattttggttctgttggtggactgttcacatcactgggaaaggctgtacaccaagtttttggaagtgtgtatacaaccatgtttggaggggtctcatggatgattagaatcctaattgggttcttagtattgtggattggcacgaattcaagaaacacttcaatggcaatgacgtgcatagctgttggaggaattactctgtttctaggtttcacagttcaagcagacatgggttgtgtggtgtcatggaatgggaaggaactaaaatgtggaagcggaatttttgtggttgacaacgtgcacacttggacagaacagtacaaattccaaccagagtccccagcgaggctagcttctgcaatattgaatgcccacaaagatggggtctgtggaatcagatcaaccacgaggctggaaaatgttatgtggaagcaaataaccaacgagctaaactatgttctctgggaaggaggacatgacctcactgtagtggccggggacgtgaagggggtgttgaccaaaggcaagagagcactcacacctccagtgaatgatctgaaatattcatggaagacatggggaaaagcaaaaatctttaccccagaagcaagaaacagcacatttttaatagacggaccagacacctccgaatgccccaatgaacgaagagcatggaacttttttgaggtagaagactatggatttggcatgtttacgaccaacatatggatgaaattccgagaaggaagttcagaagtgtgtgaccatagattaatgtcggcggcaattaaagatcagaaagctgtgcatgctgacatgggttattggatagagagctcaaaaaaccagacctggcagatagagaaagcatcccttattgaggtgaaaacatgtctgtggcccaaaacccacacgctgtggagcaatggagtgctggaaagtcagatgctcattccaagatcatatgcaggccctttttcacaacacaattaccgccaggggtatgccacgcaaaccgcgggcccatggcacttaggcaaattggagatagactttggagaatgccccggaacaacagtcacaattcaggacgattgtgaccatagaggcccatctttgaggaccaccactgcatctggaaaactggtcacgcaatggtgctgccgctcctgcacgatgcctcccttaaggttcttgggagaagatggatgttggtatgggatggagattaggcccttgagtgaaaaagaagagaacatggtcaaatcacaggtaacagccggacaaggcacatcagaaactttttctatggggttgctatgcctgaccttgttcgtggaagaatgcttaaggagaagagtcactaggaaacacatgatattggttgtagcaatcaccttctgtgctatcatcctaggaggtctcacatggatggacttactacgagcccttatcatgttaggggacaccatgtctggtagaataggaggacagattcacctagccatcatggcagtgttcaagatgtcaccaggatatgtgctgggtgtgtttttaaggaaacttacttcaagagagacagcgctaatggtaataggaatggccatgacaacggtgttttcaattccacatgacctcatggaactcattgatggaatatcattggggttgatattactaaaaatagtaacacactttgatgacacccaagtgggaaccttagccctttccctgactttcataagatcaacaacaccattagtcatggcttggaggaccatcatggctgtgttctttgtggtcacactcattcctttgtgcaggacaagctgtcttcaaaaacagtcccattgggtagaaataacagcacttatcttaggagcccaggctttgccagtgtacctaatgactctcatgaaaggagcctcaagaagatcttggcctcttaatgagggcataatggctgtgggtttggtgagcctcttaggaagcgccctcctaaagaatgatgttcctttagctggcccaatggtggcaggaggcttacttctagcggcttacgtaatgagtggtagctcagcagacctgtcactagagaaggctgccagtgtgcagtgggatgaaatggcggacataactggctcaagcccaatcatagaagtgaagcaggatgaagatggctctttctccatacgggatgtcgaggaaaccaacatgataaccctcttggtgaaactggcgctgataacagtatcaggtctttaccccttggcaattccagtcacaatggcactatggtatatttggcaagtgaaaacacaaagatcaggagctctgtgggacgttccctcgcccgctgccactcagaaagccacactgtctgaaggggtgtataggatcatgcaaagagggttgtttgggaaaactcaggttggagtagggatacacatggaaggtgtgttccacacaatgtggcacgtgacaagaggatcagtgatctgccatgagacagggagattagagccatcttgggctgacgtcaggaatgacatgatatcatacggtgggggatggaggctcggagacaaatgggacaaagaagaagatgttcaggtcctagccatagaaccaggaaaaaatcctaaacatgtccaaacgaaaccaggccttttcaagaccttaactggagaaattggagcagtaactctggatttcaaacccggaacgtctggctctccaatcattaacaagaaagggaaagttattggactctatggaaatggagtagttaccaaatcaggtgattacgtcagtgccataacgcaagccgaaagaattggtgagccagattatgaagtggatgaggacatttttcgaaagaaaagattaactataatggacttacaccccggagctggaaagacaaaaagaattctcccatcaatagtcagagaagctttgaaaaggaggctgcgaaccttgattttggctcccacgagagtggtggcggccgagatggaagaggccctacgcggactgccaatccgttatcagaccccagctgtgaaatcagagcacacaggaagagagattgtagacctcatgtgtcatgcaaccttcacaacgagacttttatcatcaaccagggttccaaattataacctcatagtgatggatgaagcacatttcactgacccttgtagtgtcgcggctagaggatacatttcaaccagggtggaaatgggagaggcagcagctatcttcatgactgcaacccctcctggatcgacagatccctttccccagagcaacagcccaatagaagacatcgagagggaaatcccagaaaggtcatggaacacagggttcgactggataacagactaccaagggagaactgtgtggtttgttcctagcataaaagctggaaatgacattgcaaattgtttgagaaagtcgggaaagagagtgatccagttgagcaggaaaacctttgacacagagtatccaaagacgaaactcacggactgggattttgtggtcaccacagacatatctgaaatgggggccaatttcagagctgggagagtgatagaccccaggagatgcctcaagccagttatcctaacagatgggccagagagagttattctagcaggtccaattccagtaactccagcaagtgccgctcagagaagagggcgaataggtaggaatccagcacaagaagatgaccaatatgttttctctggagacccactaaagaatgatgaagatcatgctcactggacagaagcaaaaatgttgcttgacaatatctacacccctgaagggataattccaacattgtttggtccggaaagggaaaaaacccaagccattgatggagagtttcgcctcagaggggagcaaaggaagacttttgtggaattgatgaggagaggagaccttccggtgtggctgagctacaaggtagcttctgccggtatctcttacaaagaccgagaatggtgcttcacaggggaaaggaataaccaaattttagaagaaaacatggaggttgaaatctggactagagagggagaaaagaaaaagctaaggccaaaatggttagatgcacgtgtgtacgctgaccccatggctctgaaggatttcaaggagtttgccagtggaagaaagagcataactcttgacatcctaacagagattgccactttgccaacttacctttcctctaaggccaagctagcccttgacaacatagtcatgctccacacaacagaaaaaggagggagggcctaccaacacgccctaaacgaactcccggagtcactggaaacactcatgcttgtagccctactaggtgctatgacagccggtatcttcctgtttttcatgcaggggaaaggaatagggaaattgtcaatgggtctgatagccatagctgtggctagtagcttgctctgggtagcagaaattcagccccagtggatagcagcttcaatcatactggagttttttcttatggtgctgttgataccagaaccagaaaaacaaaggaccccacaagacaatcaactgatctacgttatattgaccattctcaccattattggtctcatagcagccaatgagatggggctgattgaaaaaacaaaaacggactttgggttctaccaggcaaaaacagaaaccaccattcttgatgtggatttgagaccagcctcagcatggacactctatgcagtggccaccactattctgactcccatgctgagacacaccatagagaacacgtctgccaacctatctctagcagccattgccaaccaagcagctgtcctaatgggacttggaaaaggatggccgctccacagaatggacctcggtgtgccgctgttggcaatgggatgttattctcaagtgaacccaacaaccctgacagcatccctagtcatgcttttagtccattatgccataataggtccaggattacaggcaaaagccacaagagaggcccagaaaaggacagctgctgggatcatgaagaaccccacggtggacgggataacagtaatagatctagaaccaatatcctatgacccaaaatttgaaaagcaattagggcaagtcatgctactagtactgtgtgttggacaattacttttgatgagaacaacatgggctctctgcgaagtattgactttggccacaggaccaatcatgaccttgtgggagggcaacccgggaaggttttggaacacgaccatagctgtatccacagccaacatttttagaggaagctacttggcgggagctggactagctttttcgctcataaagaatgcacaaacccctaggaggggaactgggaccacaggagagacactgggagagaagtggaagagacagctaaactcattagacagaaaagagtttgaagagtacaagagaagtggaatactagaagtggataggactgaagccaagtctgccctaagagatggatctaaaaccaagcatgcggtgtccagagggtctagtaagatcagatggattgttgaaagagggatgataaagccaaaaggaaaggtcgtggatcttggttgcgggaggggaggatggtcctattacatggcgacactcaagaacgtgactgaagtgaaaggatatacaaaaggaggcccaggacatgaagaaccaatccccatggccacttatggctggaatttggtcaaactccattcaggggttgatgtgttctacaaacccactgagcaggtggacaccctgctctgtgacattggggagtcatcctctaatccgacaatagaggaaggaagaacattgagagtcttgaagatggtggagccatggctctcttcaaaacctgagttctgcatcaaagtcctcaacccctacatgccgacagttatagaagagctggagaaactgcagagaagacatggtggaagcctcgtcagatgcccgctatccaggaattctacccatgagatgtattgggtgtcaggtgcgtcgggaaacatcgtgagttctgtgaacacaatatcaaagatgctgttgaacaggttcacaacaaggcataggaaacccacttatgagaaggacgtagatcttggggcaggaacgagaagtgtctccactgaaccagaaaatccagacatgacaatcattgggagaaggcttcagagattgcgagaagagcacaaagaaacctggcactatgaccaggaaaacccatacagaacctgggcgtatcatggaagctatgaagcttcttcgacaggctcagcatcctccatggtgaacggggtagtaaaattgctgacaaaaccctgggatgtgattccaatggtgacccagttggccatgacagacacaaccccttttgggcaacaaagagtgttcaaggagaaggtggatactagaactccacaaccaaaacccggcacacgaatgattatgaccacgacagccaattggttgtgggccctcctcgggaagaagaaaagtcccagactgtgcacaaaggaagagttcatctcaaaagttaggtcaaatgcagccataggcgcagtctttcaggaagaacagggatggacatcagccagtgaagctgtgaatgacagccggttctgggaactggttgacaaagaaagggctctgcaccaggaaggaaaatgtgaatcgtgtgtctataacatgatgggaaaacgtgagaaaaaattgggagagtttggtagggccaagggaagccgagcaatctggtacatgtggctgggggcgcggttcctggaatttgaagccctgggttttttgaatgaagatcactggtttggcagagaaaactcatggagtggagtggaaggggaaggtctgcacagattggggtacatcttggaggacatagacaagaaggatggagacctgatatatgctgacgacacagcaggttgggacacgagaatcactgaggatgaccttttaaatgaagaactgatcacagaacagatggcccctcaccacaagaccctagccaaagccatcttcaaactaacctatcaaaacaaagtggtgaaagtcctcagacccacaccgaaaggagcggtaatggacattatatccaggaaagaccaaagaggtagtggacaggttggaacatatggtttaaacacattcactaacatggaagttcaactcatccgccaaatggaagctgaaggagtcatcacacaagacgacatgcagaacccaaaagggttgaaagaaagagtcgagaaatggctgaaagagtgtggcgtcgacaggttgaagaggatggcaatcagtggagatgattgcgtggtgaagcccctagatgagaggtttagcacctccctcctcttcttgaatgacatgggaaaggtgaggaaagacatcccgcaatgggaaccatccaagggatggaaaaactggcaagaggttcctttttgctcccaccattttcacaagatcttcatgaaagatggccgctcactggttgttccatgcagaaaccaggatgaactgataggaagagccagaatctcgcagggggctggatggagcttgagagaaacagcctgtctgggcaaagcttacgcccagatgtggtcgcttatgtacttccatagaagggacctgcgcctggcctccatggccatatgctcagcagttccaacagaatggtttccaacaagcagaacaacatggtcaatccacgctcatcaccagtggatgaccactgaagatatgcttaaagtgtggaacagagtgtggatagaagacaaccccaacatgactgacaagactccagtccattcgtgggaagacataccttacctagggaaaagagaggatctgtggtgtggatccctgattggactttcctccagagccacctgggcgaagaacattcacacggccataacccaggtcaggaatctgatcggaaaagaggaatacatggattacatgccagtcatgaaaagatacagcgctccttccgagagtgaaggagttctgtaa

SEQ ID NO: 1666 - DNA, 10164 bp, Dengue virus
atgaaccaacgaaagaaggtggctagaccacctttcaatatgctgaaacgcgagagaaaccgcgtatcaacccctcaagggttggtgaagagattctcgactggacttttctccgggaaaggacccttacggatggtgttggcattcatcacgtttttgagagttctttccatcccaccaacagcagggattctaaaaagatggggacagttaaagaaaaacaaggccataaagatactaactggattcaggaaggagataggccgcatgctgaacatcttgaatggaaggaaaaggtcaacaataacattgctgtgcttgattcctactgtaatggcgtttcacttgtcaacgagagatggtgaaccccttatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaagacattgattgctggtgcaatctcacgtctgcctgggttatgtatgggacatgcacccaaagtggagaacgaaggcgagagaagcgctcagtagctctaacaccacattcaggaatgggattggaaacaagggctgaaacatggatgtcatcggaaggagcttggaaacacgcccagagggtagagagttggatactcagaaacccaggattcgcgctcttggcaggttttatggcctacatgatcgggcaaacaggaatccagcgaacagtcttcttcattctaatgatgttggtcgccccatcttacggaatgcgatgcgtaggagtagggaacagagactttgtagaaggagtctcaggtggagcatgggtcgatctggtgctagaacatggaggatgtgtcacaaccatggcccagggaaaaccaaccttggattttgaactgatcaagacaacagccaaggaagtggccctgttaagaacctattgcattgaagcttccatatcaaacataaccacggcaacaagatgtccaacgcaaggagagccttacctcaaagaggaacaagatcaacagtacatatgccggagagacatggtagatagagggtggggcaacggctgtggcttgtttgggaagggaggagttgtgacatgtgcgaagttttcatgctcggggaagataacgggcaacttagtccaaattgagaaccttgaatacacagtggttgtaacagtccacaatggagacacccatgctgtaggaaatgacacatccaaccatggagtgacagccacgataacccccaggtcaccatcggttgaagttaaattaccggactatggagaattgacacttgactgtgaacctaggtccggaattgactttaatgagatgattctgatgaaaatgaaaacgaaaacgtggctcgtgcacaagcaatggtttttggacctacctctaccatggacagcaggagcagacacgttagaagttcactggaatcacaaagagagaatggtgacattcaaggttcctcatgccaaaagacaggatgtgacagtgttaggatctcaggaaggagccatgcattcagccctcgccggagccacagaagtggattccggtgatggaaaccatatgtttgcaggacacttaaagtgtaaagttcgtatggaaaagttgaggatcaagggaatgtcatacacgatgtgctcaggaaagttctcaattgataaagagatggcagaaacacaacatggaacaacagtggtaaaggtcaagtatgagggtactggagctccatgtaaagttcccatagagataagagatgtgaacaaggaaaaagtggttgggcgcatcatctcatccaccccttttgctgagaataccaacagtgtgaccaatatagaattggaacctccttttggggatagctacatagtgataggtgtgggagacagtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggctgtacaccaggtttttggcagtgtgtacacaactatgtttggaggagtctcatggatggtcagaatcctaatcgggctcttagtgttgtggattggtacgaattcaagaaacacttcaatggctatgtcgtgcatagctgttggaggaatcaccctgtttctgggcttcacagtccatgcagatatgggttgtgtggtgtcatggagtgggaaagagttgaaatgtggaagcggaatctttgtaattgacaacgtgcacacttggacagaacagtacaaatttcaaccagagtctccagcgcgactggcgtcggcaatactgaatgcccacaaagaaggggtctgtggaattagatcaaccacgaggctggaaaatgtcatgtggaagcaaataaccaatgagttaaactatgttctctgggaaggaggacatgacctcactgtagtggccggggatgtgaaaggggtgttgtccaaaggcaagagagcactcgcacctccagtgaatgacctgaaatattcatggaagacatgggggaaagcaaagatctttactccagaaacaagaaacagcacatttttggtggacggaccagacacctccgaatgccccaatgaacgaagagcatggaactttcttgaggtggaagactatggatttggcatgttcacgaccaacatatggatgaaatttcgagaaggaagttcagaagtgtgtgaccacaggctgatgtcggcagcaatcaaagaccagaaagctgtgcatgctgatatgggctattggatagagagctcaaaaaaccagacctggcagatagagaaggcatccctcatagaagtgaaaacatgtctgtggcccaagacccacacattgtggagcaatggagtgctggaaagccagatgctcatcccaaaagcatatgcaggccctatttcacagcacaactatcgccagggctatgccacgcagaccgtgggcccatggcacttgggcaaattggagatagactttggagaatgccccggaacaacagtcactgtacgagaggattgtgaccatagaggcccatctttgaggaccaccactgcatctggaaaattggtcacacagtggtgctgtcgctcctgcacgatgcctcccttaagatttttaggagaggatggatgctggtatgggatggaaatcaggcccttgaatgaaaaagaagagaacatggtcaaatcacaggtatcagccggacagggtacatcagagactttttctatggggttgttgtgcctgactttgtttgtggaagaatgcttgaggagaagagttaccaggaaacacatgatattggttgtggtgactaccctttgtgccatcattttaggaggtcttacatggatggacttactgcgtgcccttatcatgctaggggacaccatgtctggtagaatggggggacagattcatctagccatcatggcagtgttcaagatgtcaccaggatacgtgttgggtatatttctgaggaaactcacctcaagagagacagcactgatggtaataggaatggccatgacaacggtgctttcaattccacatgaccttatggaatttattgatggaatatcattagggttaatcttattaaaaatggtaacacattttgacaacactcaagtgggaaccttagcccttgccttgaccttcataaaatcaacaatgccattggtcatggcttggaggaccataatggctgtgttgtttgtggtcacactcattcctctatgtaggacaagctgtcttcaaaagcagtcccattgggtggaaataacagcactcatcctgggagcccaggctctgccagtatacctaatgactctcatgaaaggagcctcaaaaagatcttggccccttaacgagggtataatggctgtgggcttggtcagtctcttaggaagcgcccttctaaagaatgatgtccctttagctggcccaatggtggcaggaggcttacttctggcagcctacgtgatgagcggcagctcagcagacctgtcactagagaaggctgccaatgtgcagtgggatgagatggcagacataacaggctcaagcccaatcatagaagtgaagcaggatgaggatggctctttctccatacgggacgtcgaggaaaccaacatgattaccctcctggtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgagggagtatacaggatcatgcaaagagggttgtttgggaaaactcaggttggagtagggatacacacggaaggtgtgtttcatacaatgtggcatgtaacaagaggatcagtgatttgccatgagagtgggagactggagccatcttgggctgacgtcaggaacgacatgatatcatacggtgggggatggaggctcggagacaaatgggataaagaagaagatgttcaagttctagctatagaaccaggaaaaaatccgaaacatgtccaaacgaaacccggccttttcaaaacccttactggagaaattggagcagtaacattggacttcaaacccggaacatccggttctcccatcattaacaggaaaggaaaagtcatcggactctacggaaatggggtagttaccaaatcaggtgattacgttagtgccataacacaagctgaaagaattggtgagccagattatgaagtggatgaggacattttccgaaagaaaagattaactataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaacctttacaacaagacttttatcatcaaccagggttccaaattacaacctcatagtgatggatgaagcgcatttcacagacccttccagtgttgcagctagaggatatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaaccttcgacacagagtatccaaaaacgaaactcacggactgggattttgtggttaccacagacatatctgaaatgggggccaattttagagctgggagagtgatagaccccaggagatgcctcaagccagttatcttaactgatgggccagagagagttattttagctggtcccattccagtgactccagcaagcgctgctcagagaagagggcgaataggtaggaacccagcacaagaagatgaccagtatgtcttctccggagacccactaaggaatgatgaagatcatgcccactggactgaagcaaaaatgcttcttgataatatctacaccccagaagggatcattccaacactgtttggtccagaaagggaaaaaacccaagccattgacggagagttccgcctcagaggggaacaaaggaagacctttgtagaattaatgaggagaggagaccttccggtgtggctgagctacaaggtagcttctgctggtatctcttacaaagaccgggaatggtgcttcacgggggaaaggaataaccaaattttggaagaaaacatggaggttgaaatttggactagagagggagagaagaaaaaactcaggccaaaatggttagatgcacgtgtttacgctgatcccatggctttgaaggatttcaaggagtttgccagtggaagaaagagtataaccctcgacatcttgacagaaattgccagtttgccaacgtacctttcctccagggctaagctcgcccttgacaacatagtcatgctccatacaacagaaagaggagggaaggcttaccaacacgctctgaacgaactcccagagtcactagaaacactcatgcttgtagctttattaggagccatgacagcaggcatcttcctattcttcatgcaaggaaaaggaataggaaaattgtcaatgggtttgatagccattgcggtagctagtggcttactctgggtggcagaaatccagccccaatggatagcggcctcaatcatattggagttttttctcatggtgctgttggtaccagaaccagaaaaacaaaggaccccacaagacaatcaattgatctacgtcatattgaccattctcactattattgctctcgtggcagccaatgagatggggctaattgaaaaaacaaaaacggattttgggttttaccaggtaaaagcagaaaccaccatccttgatgtggacttgagaccagcttcagcatggacgctttatgcagtagctaccactatcttgactcccatgctgaggcacaccatagaaaacacgtctgcaaacttatccttggcggccattgccaaccaagcagccgtcttgatggggcttggaaaaggatggccgctccacagaatggacctcggtgtgccgctattggcaatgggatgctattcccaagtgaacccaacaactttaacagcatccttagtcatgcttctggtccattacgcaataataggtccaggattgcaggccaaagccacaagagaggctcaaaaaaggacagctgctgggatcatgaagaaccccacggtggacgggataacagttatagatttagaaccaatatcctatgacccaaaatttgagaagcagctggggcaagtcatgctactagttctgtgcgctggacagctactcttgatgagaacaacatgggccttttgtgaagtcttgactttggccacaggaccaatcttgaccttgtgggaaggcaacccgggaaggttttggaacacgaccatagccgtgtccactgccaacattttcaggggaagctacttggcgggagctggattggccttttcgctcataaagaatgcacaaacccccaggaggggaactgggaccacaggagagacactgggagaaaaatggaagagacagctaaactcgctagataggaaggagtttgaagagtacaaaagaagtggaatactagaagtggacaggactgaagccaagtctgccctaaaagatgggtccaaaatcaagtacgcagtgtccagagggaccagcaagattagatggattgttgaaagagggatggtaaagccaaaagggaaagttgtggatcttggttgcggaagaggaggatggtcgtactatatggcgacactcaagaacgtgaccgaggtgaaagggtatacaaaaggaggtccaggacatgaggaaccgattcccatggctacctatggctggaacttggtcaaactccattcaggggttgacgtgttctacaaacccactgagcaagtggacactctgctctgtgatattggggagtcatcctctaatccgacgatagaggaaggaagaacattacgagttttaaagatggtggagccatggctctcttcaaaacctgaattctgcatcaaagtcctcaatccctacatgccaacagtcatagaggagctggagaaactgcagagacgacatggtggaagtcttgtcagatgcccgctatccaggaattccactcatgagatgtattgggtgtcaggtgtgtcaggaaacatcgtgagttctgtgaacacaacatcaaagatgttgttgaacagatttaccacaaggcacaggaaacccacttatgagaaggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccttcgacaggctcaacatcctccatggtgaacggggtagttaaactgctgacaaaaccttgggacgtggttccaatggtgactcagttggctatgacagatacaaccccctttgggcaacagagagtgttcaaggagaaggttgacaccagaacaccacagccaaaacccggtacacgagtagtcatgaccacgacagccaactggctgtggactctcctcgggaggaagaaaaaccccagactgtgcacaagggaagaattcatctcaaaagttaggtcaaatgcagccataggcgcagtctttcaggaagaacagggatggacatcagccagtgaagcagtgaatgacagccgattttgggaactggttgacaaagaaagggctctgcaccaggaagggaaatgtgaatcatgtgtctataacatgatgggaaaacgtgagaaaaagttaggagaatttggcagagccaagggaagccgagcaatctggtatatgtggctgggagcgcggtttctggaatttgaagccctgggctttttgaatgaagatcactggtttggcagggaaaactcatggagtggagtggaaggggaaggtctgcataggttgggatacatcttggaggacatagataagaaggatggagatctgatatatgctgatgacacagcaggctgggacacaagaatcactgaagatgatcttctgaatgaagagctgatcacggaacagatggcccctcatcataaaatcctagctaaagccattttcaaactaacttatcaaaacaaagtggtaaaagtcctcagacctacaccgaaaggagcagtgatggacattatatccaggaaagatcaaagaggtagtggacaggttggaacatatggtttgaacacattcaccaacatggaagtacaactcatccgccaaatggaagctgaaggagtcatcacacgagatgacatgcataacccaaaagggttgaaagaaagagttgagaaatggctgaaagagtgtggtgtcgacaggttaaagaggatggcaattagtggagacgattgtgtggtgaagcctctagatgagaggttcagcacttccctcctctttttgaacgacatgggaaaggtgaggaaagacattccgcaatgggaaccatccaagggatggaaaaactggcaagaggttcctttttgctcccaccattttcataagatctttatgaaggatggccgttcactggtcgttccatgtagaaaccaggatgaactaatagggagagccagaatctcgcaaggggctggatggagtttaagagaaacggcctgtctgggcaaagcttacgcccagatgtggtcgctcatgtactttcatagaagggacctacgtttagcctccatggctatatgctcagcagtcccaacggaatggtttccaacaagcagaacaacatggtcaatccacgctcatcatcagtggatgactactgaagatatgctcaaagtgtggaacagagtgtggatagaagacaaccctaatatgattgacaaaactccagttcactcgtgggaagacataccttacctagggaaaagagaggatttgtggtgtggatccttgattggactctcttctagggccacctgggctaagaacattcacacagccataacccaggtcaggaacctgatcgggaaagaggaatatgtggattacatgccagccatgaaaagatacagcgctcatttcgagagtgaaggagttctgtaa

SEQ ID NO: 1667 - DNA, 10164 bp, Dengue virus
atgaaccaacggaaaaaggtggttagaccgcctttcaatatgctgaaacgcgagagaaaccgcgtatcaaccccccaagggttggtgaagagattctcaatcggactgttttccgggaaaggacccttacggatggtgctagcattcatcacgtttctgcgagtcctttccatcccaccaacagcagggattctgaaaagatggggacagttgaagaaaaccaaggccatcaagatactgactggatttaggaaggagataggtcgcatgctgaacatcttgaacgggaggaagaggtcaacagtaacattactgtgcttgattcccaccgtaatggcattccacttgtcaacaagagatggtgaaccccttatgatagtagcaaaacacgaaagggggaggcctctcttgtttaagacaacagagggaatcaacaaatgcactcttattgccatggatttgggtgaaatgtgtgaagacaccgtcacgtacaaatgccctttgctggtcaacaccgaacctgaagacattgactgctggtgcaatcttacgtctacctgggtcatgtatgggacatgtacccagaacggagaacggaggcgagagaagcgctcagtagctttaacaccacactcaggaatgggattggaaacaagggctgagacatggatgtcatcggaaggggcttggaaacatgcccagagagtggagagctggatactcagaaacccaggattcgcgctcttagcaggattcatggcctatatgatcgggcaaacaggaatccagcgaactgtcttctttgttctgatgatgctcgttgctccatcctacggaatgcggtgcataggagtggggaacagggattttgtggaaggggtctcaggtggagcatgggtcgatctggtgctagaacacggaggatgtgtcacaaccatggctcagggaaaaccaaccttggattttgaattgatcaagacaacagccaaggaagtggctctgttaagaacttattgcattgaagcctcgatatcaaacataaccacggcaacaagatgtccaacgcaaggagaaccttatctcaaagaggagcaagaccaacagtacatttgtcggagagatgtggttgacagagggtggggcaatggctgtggcctgtttggaaaaggaggagttgtgacatgtgcaaagttctcatgctcagggaagataacaggcaacttggttcaaattgaaaaccttgaatacacggtggttgtgacagtccacaacggagacacccacgcagtaggaaatgacacatctaaccatggagtgacagccacgataactcctaggtcaccatcagtggaagttgaattaccggactatggagagctatcacttgattgtgaacccaggtctgggattgactttaatgagatgattctgatgaagatggaaaagaagacgtggcttgtgcacaagcaatggtttttggacttgcctctgccatggacggcaggagcagatacatcagaagtccactggaatcataaagagagaatggtgacattcaaggttcctcatgccaagagacaggatgtgacagtattaggatctcaggaaggagccatgcactctgccctcaccggagccacagaagtggattcaggtgatggaaatcacatgttcgcaggacatttaaagtgcaaagtacgcatggagaaattgagaattaagggaatgtcatacacgatgtgctcaggaaaattctcaattgatagggagatggcagaaacacagcatggaacaacggtagtgaaagttaagtatgaaggtactggagctccatgcaaagtccccatagagataagggatgtgaacaaagaaaaagtggttgggcgcattatttcatctactccatttgctgagagtaccaacagtgtaaccaatatcgaattagaacccccttttggagatagctacatagtgataggtgttggagacagtgcactaacactccattggtttaggaaagggagttccattggcaagatgtttgagtccacatacagaggcgcaaagcggatggccattctaggtgaaacagcttgggactttggttctgttggtggactgttcacatcactgggaaaagccgtgcaccaggtgtttggtagtgtctacacaaccatgtttggaggagtctcatggatggttagaatcctaatcgggctcctggtgctgtggatcggcacgaactcaagaaacactccaatggcgatgacatgcatagctgttggaggaatcactctgtttctgggtttcacggttcaggcagacatgggttgtgtagtgtcatggaccgggaaagaactaaaatgtggaagtggaatttttgtgactgacaacgtgcacacttggacagagcagtaccaatttcaaccagagtccccagcgagactagcgtccgcaatattgaacgcccacaaagatggggtctgtggaatcagatcaaccactaggctggaaaatgttatgtggaaacaaataactaacgagctaaattatgttctctgggaaggaggacatgacctcactgtggtggccggggatgtgaagggggtgctggttaaaggaaagagagcactcacacctccagtaaatgatttgaaatattcatggaagacatgggggaaagcaaaaatctttactccagaagcaaaaaatagcactttcttgatagacggaccagacacttccgaatgccccaatgaacggagagcatggaactttcttgaggtagaggactatggatttggcatgttcacgaccagcatatggatgaaattccgagaaggaagctcagaagtgtgtgatcacaggttaatgtcagcggcgatcaaagatcagaaagccgtgcatgctgacatgggctattggatagagagctcaaaaaaccagacctggcagatagagaaagcatcccttattgaggtgaaaacttgtctgtggcccaagactcacacgttatggagtaatggagtgttggaaagccagatgctcatcccaaaagcatatgcaggccccttttcacagcacaattatcgccagggctatgccacgcaaaccatgggcccatggcacctaggcaaattggaaatagattttggagaatgccccggaacaacagtcacaattcaggaggattgtgatcacagaggcccatctttgaggaccaccactgcatcaggaaagttggtcacacagtggtgctgccgctcctgcacgatgcctcctttaaggtttttgggagaggatgggtgttggtatgggatggaaattaggcctttaagtgaaagagaagagaacatggtcaaatcacaagtgtcggccggacagggttcatcagaaaccttttccatggggctgttatgtctgaccctgttcatagaagaatgcttgagaagaaaagtcactaggaaacacatgatattggtcgtggtgaccaccttttgtgccatcatcctaggaggtctcacgtggatggacttactacgagccattatcatgctaggggacaccatgcttagtagggtgggaggacagactcatctagctatcatgatagtgttcaagatgtcaccaggatacgtgttgggtgtgttcctaaggaaactcacctcaagagaaacagcactaatggtgataggaatggctatgacaacggtgttttcaattccacatgaccttatggaacttattgatggaatatcattggggctgatcttactgaaaatggtaacacattttgacaacacccaagtgggaactttagccctttccttaactttcataagatcgacaatgccattgaccatggcttggagaaccatcatggctgtgttgtttgcggtcacactcattcctttatgtaggacaagctgcctgcaaaaacaatctcactgggtagagataacagcaatcatcttaggagcccaagctctgccagtctacttaatgactctcatgaaaggagcctcaaaaagatcttggcctcttaacgagggcataatggctgtgggcttggtcagtctcttaggaagtgcccttctgaagaatgatgtccctttggctggtccaatggtggcaggaggtttacttctggcagcctacgtgatgagtggtagctcagcagacctgtctctagagagggccgccaatgtgcagtgggatgagatggcagacataacaggctcaagcccaatcatagaagtgaagcaggatgaagatggctctttctccatacgggacgtcgaggaaaccaacatgataacccttttggtgaaactggcactgataaccgtgtcaggtctttaccccctggcaattccaatcacaatgactctatggtatatgtggcaagtgagaacacaacgatcaggagccctgtgggacgttccctcacccgccaccgctcagaaagccacactgactgaaggagtgtacagaatcatgcaaagagggttgttagggaaaacacaggttggagtggggatacatatggaaggtgtatttcacacaatgtggcatgtaacaagaggatcagtgatctgccatgagactgggagattggagccatcttgggctgacgtcaggaacgacatgatatcatatggtggagggtggaggcttggggacaagtgggacaaagaagaagacgttcaggtcttagccatagaaccagggaaaaatccgaagcatgtccaaacgaaacccggccttttcaagaccttaactggagaaattggagcagtaacattggatttcaaacccggaacatctggctcacccatcattaacaagaaaggaaaagttatcggactctatggaaatggagtagttaccaaatcaggtgattatgtcagcgccataacgcaagccgagagaattggtgagccagattatgaggtggatgaggacatctttcgaaagaaaagattaaccataatggacttacaccccggggctggcaagacaaaaagaattctcccttccatagtcagagaagctctaaaaaggaggttacgaaccctgattttggctcctacgagagtggtggcagccgagatggaagaagccctccgcggactaccaatccgttatcaaactccagctgtgaagtcagaacacacaggaagagagattgtagacctcatgtgtcatgcaaccttcacaacaagactcttgtcatcaaccagagtaccaaattacaatctcatagtaatggatgaagcgcacttcacagacccttctagtgttgcagctagaggatacatctcaaccagggtggaaatgggagaggcagcagccatcttcatgactgcaacccctcccggggcaacagatccattcccccaaagcaacagccccatagaagacattgagagagaaattccagaaaggtcatggaacacaggatttgactggataacagactaccaagggaagactgtgtggtttgttcccagtataaaagctggaaatgacattgcaaattgcctgagaaaatcgggaaagaaggtgatccaattgagtaggaagacctttgatactgagtacccaaaaacgaaactcacagactgggattttgtggtcaccacagacatatctgagatgggggccaatttcagagccggaagagtgatagaccccaggagatgcctcaagccagtcatcctaacagatgggccagagagagtcattttggcaggtcccattccagtgactccagcaagcgctgctcaaagaagagggcgaataggcagaaatccagcacaagaagacgatcagtatgtcttctctggagatccattgaaaaacgacgaagatcacgcccactggacagaagcaaaaatgctgcttgacaatatctacaccccggaagggatcattccaacattgtttggcccggaaagggaaaaaacccaagccattgacggagagtttcgcctcagaggagaacaaaggaagacttttgtggaattaatgaagagaggagaccttccggtgtggctgagctataaggtagcttcagctgggatttcttataaagatcgggaatggtgcttcacaggggaaagaaataatcaaatcttagaagaaaacatggaggttgaaatttggactagagagggagaaaagaaaaaactaagaccaaaatggttagatgcacgtgtctatgctgaccccatggctttgaaggacttcaaggaatttgctagtggaagaaagagcataacccttgatatcctgacagagatcgccagcctgccaacttacctctcttctagagccaagctcgcccttgacaatatagtcatgctccacacaacagaaaggggagggagggcctatcaacacgccctgaacgaactcccggagtcattggaaacactcatgcttgtagctttattaggtgctatgacagcaggcatatttctgttttttatgcaaggaaaagggatagggaaactgtcagtgggcctgatagctattgcggtagctagtggcttactctgggtagcagaaattcagccccagtggatagcggcctcaatcatactggagttctttctcatggtgttgttgatcccagaaccagaaaaacagaggaccccacaagacaaccagttgatttatgtcatactggccattctcactattattggtctcgtagcagccaacgagatggggctgattgagaaaacaaaagcggattttgggttttaccaagtaaaaacagaaaccacaatcctcgatgtggatttgagaccagcttcagcatggacgctctacgctgtagccaccaccattctgactcccatgctaagacacaccatagaaaatacatctgccaacctatctctggcggctatagctaatcaagcagctgtcctaatggggcttggaaaaggatggccactccacagaatggaccttggtgtgccgctattagcaatgggatgttattctcaagtgaacccaacaaccttgacagcgtccttggtcatgctcttggtccattatgcaataataggtccaggattacaggcaaaagctacaagagaagctcagaaaaggacagctgctgggatcatgaagaaccccacggtggatggaataacagtaatagatctagaaccaatatcttatgacccaaagtttgaaaagcagttagggcaggttatgttgctggtcttgtgtgctggacaactactcttgatgagaacaacatgggctttctgtgaagtcttaactttggccacaggaccagtcttaactttgtgggagggcaacccgggaagattttggaacacgaccatagccgtgtccactgccaacattttcaggggaagctacttggcgggagctggactggctttctcactcataaagaatgcacagacccccaggaggggaactggaaccacaggagagacactgggagagaaatggaagagacaactaaactcattagataggaaggagtttgaagagtacaagagaagtggaatattggaggtggacaggactgaagccaagtccgccctgaaagatgggtctaaaatcaagcacgcagtgtccagagggtcaagcaagatcagatggattgttgaaagagggatggtaaagccaaaagggaaagttgtggatcttggttgcgggagaggaggatggtcgtattacatggcgacgctcaagaacgtgactgaggtgaaagggtacacgaaaggaggtccaggacatgaagaacccattcccatggctacctatggctggaatttggtcaagctccattcaggagtagacgtgttctacaaacccactgagcaagtggacaccctgctctgtgatattggagagtcatcttctaatccgacaatagaggaaggaagaacattaagagttctgaagatggtggagccatggctctcttcgaagcctgaattctgcatcaaggtcctcaatccctacatgccaacagttatagaagaactggagaaactgcagagaaagcatggtggaagtctcatcagatgcccgctatccagaaattccactcatgagatgtattgggtgtcaggtgcgtcgggaaacattgtgagctctgtgaatacaacatcaaaaatgctgttgaacaggttcactacgaggcataggaaacccacctatgagaaggatgtagaccttggagctggaacaagaagtgtctccactgaaacagagaaaccagacatgacaatcattgggagaagacttcagcgattgcaagaagagcacaaagaaacttggcactatgatcaggaaaatccatacagaacttgggcgtatcatggaagctatgaagctccttcgacaggctcagcatcctccatggtaaacggggtagtaaaactgctgacaaaaccttgggacgtgattccgatggtgacccagttagccatgacagatacaaccccctttggccaacaaagagtgtttaaagagaaggtggacaccagaacaccacagccaaaactaggcacacgagtggttatgaccacaacagccaattggctgtgggccctccttgggaggaagaaaaatcccagattgtgtacgagggaagagttcatctcaaaagttaggtcaaacgcagccataggtgcggtcttccaggaagaacagggatggacatcagccagtgaagctgtgaatgacagccggttttgggaactggttgacaaagaaagggctctgcaccaagaagggaaatgtgaatcgtgcgtctacaacatgatggggaaacgtgagaagaaactgggagagttcggtagagccaaaggaagccgagcaatctggtacatgtggttgggggcgcggtttctagaatttgaagccctgggtttcctaaatgaagatcactggtttggtagagaaaattcatggagtggagtggaaggagagggtctgcacagattgggatacatcttagaagacatagataggaaggacggggacttgatgtatgctgatgacacggcaggttgggacacaagaatcactgaagatgaccttctaaatgaagaactaatcacagaacagatggctcctcaccacaggatcttagccaaagccattttcaaactgacttaccaaaataaagtggtaaaagttctcagacccacaccgaaaggagcggtcatggacatcatatccaggaaagaccaaagaggtagtggacaggttggaacatacggtttaaacacattcaccaacatggaagtacaacttatccgccaaatggaagctgaaggagttatcacacaagatgacatgcaaaacccaaaagggctgaaagaaagagttgagaaatggctgaaagagtgtggtgtcgacaggttgaaaagaatggcaatcagtggagatgattgtgtggtaaaacccctggatgagaggttcagtacttccctcctcttcttgaatgacatgggaaaagtaaggaaagacattccacagtgggaaccatccaagggatggaagaattggcaagaggtccctttctgctcccaccattttcacaagatcttcatgaaggatggccggtcactggttgttccatgtagaaaccaggatgaactgatagggagagccagaatctcgcagggggctggatggagcttgaaagaaacagcctgtttgggcaaagcttacgcccagatgtggtcactcatgtattttcacagaagggacctgcgtttagcctccatggctatatgctcagcagttccaacagaatggtttccaacaagcagaacaacatggtcaatccacgcccaccatcaatggatgactactgaagacatgctcaaagtgtggaacagagtatggattgaagacaaccctaacatgactgacaaaactccagtccactcgtgggaagacataccttacctagggaaaagagaggacttgtggtgtggatcgttgattgggctttcttccagagctacctgggcgaaaaacattcatacagccataacccaagtcaggaacctgatcgggaaagaggagtatgtggactacatgccagtcatgagaagatacagcgccctttccgagagtgaaggagttctgtaa

SEQ ID NO: 1668 - DNA, 10164 bp, Dengue virus
atgaaccaacgaaaaaaggtggttagaccacctttcaatatgctgaaacgcgagagaaaccgcgtatcaacccctcaagggttggtgaagagattctcgaccggacttttttccgggaaaggacccttacggatggtgttagcattcatcacgtttttgcgagtcctttccatcccaccaacagcagggattctgaaaagatggggacagttaaagaaaaacaaggccatcaagatactaactggattcaggaaggagataggccgcatgctgaacatcttgaatggaaggaaaaggtcaacaataacattgttgtgcttgattcccaccgtaatggcgtttcacttgtcaacgagagatggtgaaccccttatgatagtggcgaaacacgaaagggggagacctctcttgtttaagacaacagaaggaatcaataagtgcactcttattgccatggacctgggtgaaatgtgcgaggacaccgtcacgtataaatgccctttactggtcaataccgaacccgaagacattgattgctggtgcaatctcacgtctgcctgggtcatgtatgggacatgcacccaaagtggagaacggagacgagagaagcgctcagtagctctaacaccacattcaggaatgggattggaaacaagagctgaaacatggatgtcatcggaaggagcttggaaacacgcccagagggtagagagttggatactcagaaacccaggattcgcgctcttggcaggatttatggcctatatgatcgggcaaacaggaatccagcgaacagtcttctttattctaatgatgctggtcgccccatcctacggaatgcgatgcgtaggagtggggaacagagactttgtagaaggagtctcaggtggagcatgggtcgatctggtgctagaacatggaggatgtgtcacaaccatggcccagggaaaaccaaccttggattttgaactgatcaagacaacagccaaggaagtggctctgttaagaacctattgcattgaagcctccatatcaaacataaccacggcaacaagatgtccaacgcaaggagagccttacctcaaagaggaacaagatcaacagtacatctgccggagagacgtggtagatagagggtggggcaacggctgtggcttgtttgggaaaggaggtgttgtgacatgtgcgaagttttcatgctcggggaagataacaggcaacttagtccaaattgagaaccttgaatacacagtggttgtaacagtccacaatggagacacccatgctgtaggaaatgatacatccaaccacggagtgacagccacgataacccccaggtcaccatcggtagaagttaaactaccggactatggagaattaacacttgattgtgaacctaggtccggaattgattttaatgagatgattctgatgaaaatgaaaaagaaaacgtggctcgtgcacaagcaatggtttttggatctacctctaccatggacagcaggagcagacacgtcagaagttcattggaatcacaaagagagaatggtgacattcaaggttcctcatgccaagagacaggatgtgacagtgctaggatctcaggaaggagccatgcattcagccctcaccggagccacagaagtggattccggtgatggaaaccacatgtttgcaggacatttaaagtgtaaagttcgtatggagaaattgaggatcaagggaatgtcatacacgatgtgctcaggaaagttctcaattgataaagagatggcagaaacacagcatgggacaacagtggtaaaagtcaagtatgagggtgctggagctccatgtaaagttcccatagagataagagatgtgaacaaggaaaaagtggttgggcgtatcatctcatccaccccttttgctgagaataccaacagtgtgaccaatatagaattggaacccccttttggggatagctacatagtaataggtgtaggagacagtgcattaacactccattggttcaggaaagggagctccattggcaagatgtttgagtccacgtatagaggcgcaaagcgcatggccattctaggtgaaacagcttgggattttggttctgtcggtggactgctcacatcattgggaaaggctgtacaccaggtttttggcagtgtgtatacaactatgtttggaggagtctcatggatggttagaatcctaatcgggttcttagtgttgtggattggcacgaattcaagaaacacttcaatggcaatgtcgtgcatagctgttggaggaattactctgtttctgggcttcacagttcatgcagacatgggttgtgcggtgtcatggagtgggaaagagttgaaatgtggaagcggaatttttgtaattgacaacgtgcacacttggacagaacagtacaaatttcaaccagagtctccagcgagactggcgtcggcaatactgaatgcccacaaagatggggtctgtggaattagatcaaccacgaggctggaaaatgtcatgtggaagcaaataaccaatgagttaaactatgtcctctgggaaggaggacatgacctcactgtagtggccggggatgtgaaaggggtgttgtccaaaggcaagagagcactcgcacctccagtgaatgacctgaaatattcatggaagacatggggaaaagcaaagatctttactccagaaacaagaaacagtacatttttaatagacggaccggacacctccgaatgccccaatgaacgaagagcatggaactttcttgaggtggaagactatggatttggcatgttcacgaccaacatatggatgaaatttcgagaaggaagttcagaagtgtgtgaccacaggttgatgtcggcggcaatcaaagaccagaaagctgtgcatgctgatatgggctattggatagagagctcaaaaaaccagacctggcagatagagaaagcatccctcattgaagtgaaaacatgtctgtggcccaagacccacacattgtggagcaatggagtgctggaaagccagatgctcatcccaaaagcatatgcagggcctttttcacagcacaattaccgccagggctatgccacgcagaccgtgggcccatggcacttgggcaaattggagatagactttggagaatgccccggaacaacagtcactattcaagaggattgtgaccatagaggcccatctttgaggaccaccactgcatctggaaaattggtcacgcagtggtgctgtcgctcctgcacgatgcctcccttaagatttttaggagaggatggatgctggtatgggatggaaatcaggcccttgagtgaaaaagaagagaacatggtcaaatcacaagtatcagccggacagggtacatcagaaactttttctatggggctgctatgcctgactttgtttgtggaagaatgcttgaggagaagagtcaccaggaaacacatgatattggttgtggtgaccaccctttgtgccatcattttaggaggtcttacatggatggacttactgcgtgctcttatcatgctaggggacaccatgtctagtagaatgggaggacagattcacctagccatcatggcagtgttcaagatgtcaccaggatacgtgctgggtatatttttgaggaaactcacctcaagagagacagcactaatggtaataggaatggccatgacaacggtgctttcaattccacatgaccttatggaatttattgatggaatatcattagggttaatcttattaaaaatggtaacacattttgacaacactcaagtgggaaccttagccctttccttgaccttcataaaatcaacaatgccattggtcatggcttggaggactataatggctgtgttgtttgtggtcacactcattcctctatgcaggacaagctgtcttcaaaagcagtcccattgggtggaaataacagcactcatcctgggagcccaggctctgccagtgtacctaatgactctcatgaaaggagcctcaaaaagatcttggccccttaacgagggtataatggctgtgggcttggtcagtctcttgggaagcgcccttctaaagaatgatgtccctttagctggcccaatggtggcaggaggcttacttctggcagcctacgtgatgagcggcagctcagcagacctgtcactagagaaggctgccaatgtgcagtgggatgagatggcagacataacaggctcaagcccaatcatagaagtgaagcaggatgaagatggctctttctccatacgggacgtcgaggaaaccaacatgattaccctcctggtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgagggagtgtacaggatcatgcaaagagggttgtttgggaaaactcaggttggagtagggatacacatggaaggtgtatttcatacaatgtggcatgtaacaagaggatcagtgatctgccatgagagtgggagactggagccatcttgggctgacgtcaggaacgacatgatatcatacggtgggggatggaggctcggagacaaatgggataaagaagaagatgttcaagttctagctatagaaccaggaaaaaatccgaaacatgtccaaacgaaacccggccttttcaaaacccttactggagaaattggagcagtaacattggacttcaaacccggaacatccggttctcccatcattaacaggaaaggaaaagtcatcggactctacggaaatggggtagttaccaaatcaggtgattacgtcagtgccataacacaagctgaaagaattggtgagccagattatgaagtggatgaggacatttttcgaaagaaaagattaactataatggacttacatcccggagccggaaagacaaaaagaatactcccatcaatagtcagagaagccttaaaaaggaggctgcgaaccctgattctggctcccacgagagtggtggcggccgaaatggaagaagccctacgtggactgccaatccgttatcagaccccagctgtgaaatcagaacacacaggaagagagatcgtagacctcatgtgtcatgcaaccttcacaacaagacttttgtcatcaaccagggttccaaattacaaccttatagtgatggatgaagcgcatttcacagacccctctagtgtcgcagctagaggatatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacagactaccaagggaaaactgtgtggtttgttcccagcataaaagctggaaatgacattgcaaattgcttgagaaaatcgggaaagaaggtcatccaattgagcagaaaaacctttgacacagagtatccaaaaacgaaactcacggactgggattttgtggttaccacagacatatctgaaatgggggccaattttagagctgggagagtgatagaccccaggagatgcctcaagccagttatcttaactgacgggccagagagagttattttagcgggtcccattccagtgactccagcaagcgctgctcagagaagagggcgaataggtaggaacccagcacaagaagatgaccaatatgtcttctccggagacccactaaggaatgatgaagatcatgcccactggactgaagcaaagatgcttcttgataatatctacaccccagaagggatcattccaacattgtttggtccagaaagggaaaaaacccaagccattgacggagagttccgcctcagaggggaacaaaggaagacttttgtagaattaatgaggagaggagaccttccggtgtggctgagctacaaggtagcttctgctggtatctcttacaaagaccgggaatggtgcttcacgggggaaaggaataaccaaattttagaagaaaacatggaggttgaaatttggactagagagggagagaagaaaaaactcaggccaaaatggttagatgcacgtgtttacgctgatcccatggctttgaaggatttcaaggagtttgccagtggaagaaagagtataaccctcgacatcttaacagaaattgccagtttgccaacgtacctttcctctagggctaagctcgcccttgacaacatagtcatgctccacacaacagaaagaggagggaaggcctaccaacacgccctgaacgaactcccagagtcactagaaacactcatgcttgtagctttactaggagccatgacagcaggcatcttcttgttcttcatgcaaggaaaaggaatagggaaattgtcaatgggtttgatagccattgcggtagctagtggcttgctctgggtggcagaaatccagccccagtggatagcggcctcaatcatactggagttttttctcatggtgctgttggtaccagaaccagaaaaacaaaggaccccacaagacaatcaattgatctacgtcatattgaccattctcactattattggtctcgtggcagccaatgagatggggctaattgaaaaaacaaaaacggattttgggttttaccaggtaaaaacagaaaccaccatccttgatgtggacttgagaccagcctcagcatggacgctctatgcagtagccaccactatcttgactcccatgctgagacacaccatagaaaacacgtctgcaaacctatctttagcggccattgccaaccaggcagccgtcttaatggggcttggaaaaggatggccgctccacagaatggacctcggtgtgccgctattggcaatgggatgctattcccaagtgaacccaacgactttaacagcatccttagtcatgcttctagtccattatgcaataataggtccaggattgcaggctaaagccacaagagaggcccagaaaaggacagctgctgggatcatgaagaaccccacggtggacgggataacagttatagatctagaaccaatatcctatgacccaaaatttgaaaagcagctagggcaagtcatgctactagttctgtgcgctggacagctactcttgatgagaacaacatgggccttctgtgaagtcttgactttggccacaggaccaatcttgaccttgtgggaaggcaacccgggaaggttctggaacacgaccatagccgtgtccactgccaatattttcaggggaagctacttggcgggagctggattggccttttcgctcataaagaatgcacaaacccccaggaggggaactgggaccacaggagagacactgggagaaaagtggaagagacagctaaactcactagataggaaggagtttgaagagtacaaaagaagtggaatactagaagtggacaggactgaagccaagtctgccctgaaagatgggtctaaaatcaagtatgcagtgtccagagggaccagcaagattagatggattgttgaaagagggatggtaaagccaaaagggaaagttgtggatcttggttgcgggagaggaggatggtcgtactacatggcgacactcaagaacgtgaccgaggtgaaagggtatacaaaaggaggtccaggacatgaagaaccgattcccatggctacatatggctggaacttggtcaaactccattcaggggttgacgtgttctacaaacccactgagcaagtggacaccctgctctgtgatatcggggagtcatcctctaatccgacgatagaggaaggaagaacattacgagttttaaagatggtggagccatggctctcttcaaaacctgaattctgcatcaaagtccttaacccctacatgccaacagtcatagaggagctggagaaactgcagagaaaacatggtggaagtcttgtcagatgcccgctatccaggaattccactcatgagatgtactgggtgtcaggtgtgtcaggaaacatcgtgagttctgtgaacacaacatcaaagatgttgttgaacagatttaccacaaggcataggaaacccacttatgagaaggacgcagaccttggagcaggaacgagaagtgtctccactgaaacagaaaaaccagatatgacaatcatcgggagaagactccagcgattgcaagaagagcacaaagaaacctggcactatgatcaggaaaatccatacagaacctgggcgtatcatggaagctatgaagctccttcgacaggctcagcatcctccatggtgaacggggtggttaaactgctgacaaaaccctgggacgtgattccaatggtgacccagttggctatgacagacacaaccccttttgggcaacagagagtgttcaaagagaaagttgacaccagaacaccacagccaaaacccggtacacgaatggttatgaccacgacagccaactggctgtgggctctcctcgggaagaagaaaaatcccagactgtgcacaagagaagagttcatctcaaaagttaggtcaaatgcagccataggcgcagtctttcaggaagaacagggatggacatcagccagtgaagctgtaaatgacagccgattttgggaactggttgacaaagaaagggctctgcaccaggaagggaaatgtgaatcatgtgtctataacatgatgggaaaacgtgagaaaaagttaggagagtttggcagagccaagggaagccgggcaatctggtacatgtggctgggagcgcggtttctggaatttgaagccctgggttttctgaatgaagatcactggtttggcagggaaaactcatggagtggagtggaaggggaaggtctgcataggttgggatatatcttggaggacatagataagaaggatggagatctgatatatgctgatgacacagcaggctgggacacaagaatcactgaagatgaccttctgaatgaagagctgatcacggaacagatggcccctcatcataagatcctagccaaagctattttcaaactaacttatcaaaacaaagtggtaaaagtcctcagacccacaccgaaaggagcagtgatggacattatatctaggaaagatcaaagaggtagtggacaggttggaacatatggtttgaacacattcaccaacatggaagtacaactcatccgccaaatggaagctgaaggagtcatcacacgagatgacatgcataacccaaaagggttgaaagaaagagttgagaaatggctgaaagagtgtggtgtcgacaggttaaagaggatggcaatcagtggagacgattgtgtggtgaagcctctggatgagaggttcagcacttccctcctcttcttgaacgacatgggaaaggtgaggaaagacattccgcaatgggaaccatccaagggatggaaaaactggcaagaggttcctttttgctcccaccactttcacaagatctttatgaaggatggccgctcactggttgttccatgtagaaaccaggatgaactgatagggagagccagaatctcgcaaggggctggatggagtttaagagaaacagcctgtctgggcaaagcttacgcccagatgtggtcgctcatgtactttcatagaagggacctgcgtttagcctccatggccatatgctcagcagtcccaacggaatggtttccaacaagcagaacaacatggtcaatccacgctcatcatcagtggatgaccactgaagatatgctcaaagtgtggaacagagtgtggatagaagacaaccctaatatgattgacaaaactccagttcactcgtgggaagacataccttacctagggaaaagagaggatttgtggtgtggatccttgattggactctcttctagggccacctgggcgaagaacattcacacagccataacccaggtcaggaacctgatcgggaaagaggagtatgtggattacatgccagtcatgaaaagatacagcgctcctttcgagagtgaaggagttctgtaa

SEQ ID NO: 1669 - DNA, 10164 bp, Dengue virus
atgaaccaacgaaaaaaggtggctagaccacctttcaatatgctgaaacgcgagagaaaccgcgtatcaacccctcaagggttggtgaagagattctcgaccggacttttttccgggaaaggacccttacggatggtgttggcattcattacgtttttgcgagttctttccatcccaccaacagcagggattctgaaaagatggggacagttaaagaaaaacaaggccataaagatactaactggattcaggaaggagataggccgcatgctgaacatcttgaatggaaggaaaaggtcaacaataacattgctgtgcttgattcctactgtaatggcgtttcacttgtcaacgagagatggtgaacccctcatgatagtggcgaaacacgaaagggggagacctctcttgtttaagacaacagaaggaatcaataagtgcactcttattgccatggacctgggtgagatgtgcgaggacaccgtcacgtataaatgccccttactggtcaataccgaacccgaagacattgattgctggtgcaatctcacgtctgcctgggttatgtatgggacatgcacccaaagtggagaacgaaggcgagagaagcgctcagtagctctaacaccacattcaggaatgggattggaaacaagggctgaaacatggatgtcatcggaaggagcttggaaacacgcccagagggtagagagttggatactcagaaacccaggattcgcgctcttggcagggtttatggcctacatgatcgggcaaacaggaatccagcgaacagtcttcttcattctaatgatgctggtcgccccatcttacggaatgcgatgcgtaggagtagggaacagagactttgtagaaggagtctcaggtggagcatgggtcgatctggtgctagaacatggaggatgtgtcacaaccatggcccagggaaaaccaaccttggattttgaactgatcaagacaacagccaaggaagtggctctgttaagaacctattgcattgaagcttccatatcaaacataaccacggcaacaagatgtccaacgcaaggagagccttacctcaaagaggaacaagatcaacagtacatctgccggagagacatggtagatagagggtggggcaacggctgtggcttgtttgggaaaggaggagttgtgacatgtgcgaagttttcatgctcggggaagataacgggcaacttagtccaaattgagaaccttgaatacacagtggttgtgacagtccacaatggagacacccatgctgtaggaaatgacacatccaaccacggagtgacagctacgataacccccaggtcaccatcggttgaagttaaattaccggactatggagaattgacacttgactgtgaacctaggtccggaattgactttaatgagatgattctgatgaaaatgaaaacgaaaacgtggctcgtgcacaagcaatggtttttggatctacctctaccatggacagcaggagcagacacgttagaagttcactggaatcacaaagagagaatggtgacattcaaggttcctcatgccaagagacaggatgtgacagtgctaggatctcaggaaggagccatgcattcagccctcgccggagccacagaagtggattccggtgatggaaaccatatgtttgcaggacacttaaagtgtaaagttcgtatggaaaagttgaggatcaagggaatgtcatacacgatgtgctcaggaaagttctcaattgataaagagatggcagaaacacagcatggaacaacagtggtaaaggtcaagtatgagggtactggagctccatgtaaagttcccatagagataagagatgtgaacaaggaaaaagtggttgggcgcatcatctcatctaccccttttgctgagaataccaacagtgtgaccaatatagaattggaacctccttttggggatagctacatagtgataggtgtgggagacagtgcattaacactccattggttcaggaaagggagctccattggcaagatgtttgagtccacatacagaggtgcaaagcgcatggccattctaggtgaaacagcttgggattttggttccgttggtggactgctcacgtcattaggaaaggcagtacaccaggtttttggcagtgtgtatacaactatgtttggaggagtctcatggatggtcagaatcctaatcgggctcttagtgttgtggattggcacgaattcaagaaacacttcaatggctatgtcgtgcatagctgttggaggaatcaccctgtttctgggcttcacagttcatgcagacatgggttgtgcggtgtcatggagtgggaaagagttgaaatgtggaagcggaatttttgtaattgacaacgtgcacacttggacagaacagtacaaatttcaaccagagtctccagcgcgactggcgtcggcaatactgaatgcccacaaagatggggtctgtggaattagatcaaccacgaggctggaaaatgtcatgtggaagcaaataaccaatgagttaaactatgttctctgggaaggaggacatgacctcactgtagtggccggggatgtgaaaggggtgttgtccaaaggcaagagagcactcgcacctccagtgaatgacctgaaatattcatggaagacatggggaaaagcaaagatctttactccagaaacaagaaacagcacatttttggtagacggaccagacacctccgaatgccccaatgaacgaagagcatggaactttcttgaggtggaagactatggatttggcatgttcacgaccaacatatggatgaaatttcgagaaggaagttcagaagtgtgtgaccacaggctgatgtcggcggcaatcaaagaccagaaagctgtgcatgctgatatgggctattggatagagagctcaaaaaaccagacctggcagatagagaaggcatccctcattgaagtgaaaacatgtctgtggcccaagacccacacattgtggagcaatggagtgctggaaagccagatgctcatcccaaaagcatatgcaggccctatttcacagcacaactatcgccagggctatgccacgcagaccgtgggcccatggcacttgggcaaattggagatagactttggagaatgccccggaacaacagtcactatacaagaggattgtgaccatagaggcccatctttgaggaccaccactgcatctggaaaattggtcacgcagtggtgctgtcgctcctgcacgatgcctcccttaagatttttaggagaggatggatgctggtatgggatggaaatcaggcccttgaatgaaaaagaagagaacatggtcaaatcacaggtatcagccggacagggtacatcagagactttttctatggggctgttatgcctgactttgtttgtggaagaatgcttgaggagaagagtcaccaggaaacacatgatattggttgtggtgaccaccctttgtgccatcattttaggaggtcttacatggatggacttactgcgtgcccttatcatgctaggggacaccatgtctggtagaatggggggacagattcatctagccatcatggcagtgttcaagatgtcaccaggatacgtgttgggtatatttctgaggaaactcacctcaagagagacagcactaatggtaataggaatggctatgacaacggtgctttcaattccacatgaccttatggaatttattgatggaatatcattagggttaatcttattaaaaatggtaacacattttgacaacactcaagtgggaaccttagccctttccttgaccttcataaaatcaacaatgccattggtcatggcttggaggaccataatggctgtgttgtttgtggtcacactcattcctctatgtaggacaagctgtcttcaaaagcagtcccattgggtggaaataacagcacttatcctgggagcccaggctctgccagtatacctaatgactctcatgaaaggagcctcaaaaagatcttggccccttaacgagggtataatggctgtgggcttggtcagtctcttaggaagcgcccttctaaagaatgatgtccctttagctggcccaatggtggcaggaggcttacttctggcagcctacgtgatgagcggcagctcagcagacctgtcactagagaaggctgccaatgtgcagtgggatgagatggcagacataacaggctcaagcccaatcatagaagtgaagcaggatgaagatggctctttctccatacgggacgtcgaggaaaccaacatgattaccctcctggtgaaactggcactgataacagtgtcaggtctctaccccttggcaattccagtcacaatgaccctatggtacatgtggcaagtgaaaacacaaagatcaggagccctgtgggacgtcccctcacctgctgccgctcagaaagccacactgactgagggagtatacaggatcatgcaaagagggttgtttgggaaaactcaggttggagtagggatacacatggaaggtgtatttcatacaatgtggcatgtaacaagaggatcagtgatttgccatgagagtgggagactggagccatcttgggctgacgtcaggaacgacatgatatcatacggtgggggatggaggctcggagacaaatgggataaagaagaagatgttcaagttctagctatagaaccaggaaaaaatccgaaacatgtccaaacgaaacccggccttttcaaaacccttactggagaaattggagcagtaacattggacttcaagcccggaacatccggttctcccatcattaacaggaaaggaaaagtcatcggactctacggaaatggggtagttaccaaatcaggtgattacgttagtgccataacacaagctgaaagaattggtgagccagattatgaagtggatgaggacattttccgaaagaaaagattaactataatggatttacatcccggagccggaaagacaaaaagaatcctcccatcaatagttagagaagccttaaaaaggaggctgcgaaccttgattctggctcccacgagagtggtggcggccgaaatggaagaagcgctacgtggactgccaatccgttatcagaccccagctgtgaaatcagaacacacaggaagagagatcgtagacctcatgtgtcatgcaaccttcacaacaagacttttatcatcaaccagggttccaaattacaacctcatagtgatggatgaagcgcatttcacagacccttctagtgttgcagctagaggatatatctcaaccagggtggaaatgggagaggctgcagctatctttatgactgcaacccctcctggaacgacagatcccttcccccagagcaacagcccaatagaagacatcgagagagaaatcccagaaaggtcatggaacacagggtttgactggataacggactaccaagggaaaactgtgtggtttgttcccagcataaaagctggaaatgacattgcaaattgcttgagaaaatcgggaaagaaggtcatccaattgagcaggaaaacctttgacacagagtatccaaaaacgaaactcacggactgggattttgtggttaccacagacatatctgaaatgggggccaattttagagctgggagagtgatagaccccaggagatgcctcaagccagttatcttaactgatgggccagagagagttattttagcgggtcccattccagtgactccagcaagtgctgctcagagaagagggcgaataggtaggaacccagcacaagaagatgaccaatatgtcttctccggagacccactaaggaatgatgaagatcatgcccactggactgaagcaaagatgcttcttgataatatctacaccccagaagggatcattccaacactgtttggtccagaaagggaaaaaacccaagccattgacggagagttccgcctcagaggggaacaaaggaagacctttgtagaattaatgaggagaggagaccttccggtgtggctgagctacaaggtagcttctgctggtatctcttacaaagaccgggaatggtgcttcacgggggaaaggaataaccaaatcttagaagaaaacatggaggttgaaatttggactagagagggagagaagaaaaaactcaggccaaaatggttagatgcacgtgtttacgctgatcccatggctttgaaggatttcaaggagtttgccagtggaagaaagagtataaccctcgacatcttaacagaaattgccagtttgccaacgtacctttcctctagggctaagctcgcccttgacaacatagtcatgctccacacaacagaaagaggagggaaggcctaccaacacgccctgaacgaactcccagagtcactagaaacactcatgcttgtagctttattgggagccatgacagcaggcatcttcctattctttatgcaaggaaaaggaataggaaaattgtcaatgggtttgatagccattgcggtagctagtggcttactctgggtggcagaaatccagccccagtggatagcggcctcaatcatattggagttttttctcatggtgctgttggtaccagaaccagaaaaacaaaggaccccgcaagacaatcaattgatctacgtcatattgaccattctcactattattgctctcgtggcagccaatgagatggggctaattgaaaaaacaaaaacggattttgggttttaccaggcaaaaacagaaaccaccatccttgatgtggacttgagaccagcttcagcatggacgctctatgcagtagccaccactatcttgactcccatgctgaggcacaccatagaaaacacgtctgcaaacttatctttggcggccattgccaaccaagcagccgtcttaatggggcttggaaaaggatggccgctccacagaatggacctcggtgtgccgctattggcaatgggatgctattcccaagtgaacccaacgactttaacagcatccttagtcatgcttctggtccattatgcaataataggtccaggattgcaggccaaagccacaagagaggctcaaaaaaggacagctgctgggatcatgaagaatcccacggtggacgggataacagttatagatctagaaccaatatcctatgacccaaaatttgaaaagcagctggggcaagtcatgctactagttctgtgcgctggacagctactcttgatgagaacaacatgggccttctgtgaagtcttgactttggccacaggaccaatcttgaccttgtgggaaggcaacccgggaaggttttggaacacgaccatagccgtgtccactgccaacattttcaggggaagctacttggcgggagctggattggccttttcgctcataaagaatgcacaaacccccaggaggggaactgggaccacaggagagacactgggagaaaaatggaagagacagctaaactcgctagataggaaggagtttgaagagtacaaaagaagtggaatactagaagtggacaggactgaagccaagtctgccctaaaagatgggtctaaaatcaagtacgcagtgtccagagggaccagcaagattagatggattgttgaaagagggatggtaaagccaaaagggaaagttgtggatcttggttgcgggagaggaggatggtcgtactatatggcgacactcaagaacgtgaccgaggtgaaagggtatacaaaaggaggtccaggacatgaggaaccgattcccatggctacctatggctggaacttggtcaaactccattcaggggttgacgtgttctacaaacccactgagcaagtggacaccctgctctgtgatattggggagtcatcttctaatccgacgatagaggaaggaagaacattacgagttttaaagatggtggagccatggctctcttcaaaacctgaattctgcatcaaagtcctcaatccctacatgccaacagtcatagaggagctggagaaactgcagagaaaacatggtggaagtcttgtcagatgcccgctatccaggaattccactcatgagatgtattgggtgtcaggtgtgtcaggaaacatcgtgagttctgtgaacacaacatcaaagatgttgttgaacagatttaccacaaggcacaggaaacccacttatgagaaggacgcagaccttggagcaggaacgagaagtgtctccaccgaaacagaaaaaccagacatgacaatcatcgggagaagactccagcgattgcaagaagagcacaaagaaacttggcactatgatcatgaaaatccatacagaacctgggcgtatcatggaagctatgaagctccttcgacaggctcagcatcctccatggtgaacggggtagttaaactgctgacaaaaccctgggacgtggttccaatggtgacccagttggctatgacagacacaaccccttttgggcaacagagagtgttcaaggagaaggttgacaccagaacaccacagccaaaacccggtacacgagtggtcatgaccacgacagccaactggctgtgggctctcctcgggaggaagaaaaatcccagactgtgcacaagggaagaattcatctcaaaagttaggtcaaatgcagccataggcgcagtctttcaggaagaacagggatggacatcagccagtgaagctgtgaatgacagccgattttgggaactggttgacaaagaaagggctctgcaccaggaagggaaatgtgaatcatgtgtctataacatgatgggaaaacgtgagaaaaagttaggagaatttggcagagccaagggaagccgagcaatctggtacatgtggctgggagcgcggtttctggaatttgaagccctgggctttctgaatgaagatcactggtttggcagggaaaactcatggagtggagtggaaggggaaggtctgcataggttgggatatatcttggaggacatagataagaaggatggagatctgatatatgctgatgacacagcaggctgggacacaagaatcactgaagatgaccttctgaatgaagagctgatcacggaacagatggcccctcatcataaaatcctagctaaagccattttcaaactaacttatcaaaacaaagtggtaaaagtcctcagacccacaccgaaaggagcagtgatggacattatatccaggaaagatcaaagaggtagtggacaggttggaacatatggtttgaacacattcaccaacatggaagtacaactcatccgccaaatggaagctgaaggagtcatcacacgagatgacatgcataacccaaaagggttgaaagaaagagttgagaaatggctgaaagagtgtggtgtcgacaggttaaagaggatggcaatcagtggagacgattgtgtggtgaagcctctggatgagaggttcagcacttccctcctctttttgaacgacatgggaaaggtgaggaaagacattccgcaatgggaaccatccaagggatggaaaaactggcaagaggttcctttttgctcccaccactttcacaagatctttatgaaggatggccgttcactggtcgttccatgtagaaaccaggatgaactaatagggagagccagaatctcgcaaggggctggatggagtttaagagaaacagcctgtctgggcaaagcttacgcccagatgtggtcgctcatgtactttcatagaagggacctacgtttagcctccatggctatatgctcagcagtcccaacggaatggtttccaacaagcagaacaacatggtcaatccacgctcatcatcagtggatgactactgaagatatgctcaaagtgtggaacagagtgtggatagaagacaaccctaatatgattgacaaaactccagttcactcgtgggaagacataccttacctagggaaaagagaggatttgtggtgtggatccttgattggactctcttctagggccacctgggctaagaacattcaaacagccataacccaggtcaggaacctgatcgggaaagaggagtatgtggattacatgccagtcatgaaaagatacagcgctcatttcgagagtgaaggagttctgtaa

SEQ ID NO: 1670 - DNA, 10164 bp, Dengue virus; identical to SEQ ID NO: 1662

SEQ ID NO: 1671 - DNA, 2700 bp, Dengue virus
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1672 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaacggggagaaacagatcatcatgcagtaagtagagggagcgcaaaactaagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1673 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1674 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggatttaggatgtgggagggggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1675 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagaggggggtggtcctattactgcggcggactcaagaatgtccgcgaagtgaagggccttacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1676 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaaccaaggggggccctggtcacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1677 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttctttgtgcctcctgaaaaatgcgatactctactctgtgatataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1678 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatccgaccgttgaggcggggaggacactccgcgtcctcaacctggtcgagaattggctgaataataatactcagttttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1679 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccttccgttattgagcgtatggaaacgctccagcggaagtacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1680 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggcgctctagttcgaaatcccctctccagaaattccactcacgaaatgtattgggtaagtaacgcatcaggtaatatagtctcatctgtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1681 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgcgccataaaaaggcgacatatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1682 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagatatcatcggtaagcgtatcgagaagatcaagcaggagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1683 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcctggcattacgatcaagatcatccatacaaaacctgggcatatcacggaagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1684 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaagcagacgggcagcgccagttcaatggtgaacggcgttgtccgtctgcttaccaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1685 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgtcgtgcccatggtcacccagatggccatgacggacacgacgccctttgggcaacagagggtgttcaaagagaaggtggacacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1686 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1687 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1688 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1689 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggaagtagggcaatttggtacatgtggttaggggcgagattcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1690 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaacgaggaccattggttctcgagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1691 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1692 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaagctcgcggaggcgatcttcaagctcacgtaccagaataaggtggtgcgtgtccaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1693 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcagcgtcccacgcctcgtgggacggtgatggatataatatccaggagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1694 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaggggatcttcaagtcgatccagcacctcaccgcctcggaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1695 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatagccgttcaggactggctcgctagagtcggtcgtgagcggctgtcccggatggcaatatccggggatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1696 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1697 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1698 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1699 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacgacgtggagcatccacgcgtcccacgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1700 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgactacagaagatatgttaacagtatggaacaaagtatggattttagaaaacccttggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1701 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaagacacctgtagagagctgggaagaaataccatatttaggaaaaagggaagatcaatggtgcggaagcctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1702 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctcacgtcgagggcgacgtgggccaagaacattcagacggccataaaccaagtcagatccctcattggcaatgaggaatacacagattacatgccatccatgaaaagattcagaagagaagaggaagaggcaggagttttgtgg

SEQ ID NO: 1703 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaaagaaatttggtcacaccagaagggaaagtagtggaccttggttgcggcagagggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacaccgactacatgcctagcatgaagcgcttccgccgggaagaggaggaagcgggtgtattgtgg

SEQ ID NO: 1704 - DNA, 2700 bp, Artificial sequence; identical to SEQ ID NO: 1673
  engineered viruses

SEQ ID NO: 1705 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggagggggggctggtcatactattgtggaggattaaagaatgtaagagaagtcaaaggcttaacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1706 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttacaaaaggaggaccaggacacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1707 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttttttgttccaccagagaagtgtgacacattgttgtgtgacataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1708 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatcccacggtagaagcgggacgaacactcagagtccttaacctagtggaaaattggttgaacaataacacccaattttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1709 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccctcagtcattgaaagaatggaaaccttacaacggaaatacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1710 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggagccttggtgagaaatccactctcacggaattccacacatgagatgtactgggtgtccaatgcttccgggaacatagtgtcatcagtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1711 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgagacacaagaaggccacctatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1712 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagacataattgggaaaagaatagaaaaaataaaacaagagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1713 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcatggcactatgaccaagaccacccatacaaaacatgggcttaccatggcagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1714 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaaacagactggatcagcatcatccatggtgaacggagtagtcagattgctgacaaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1715 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgttgttccaatggtgacacagatggcaatgacagacacaactcctttcggacaacagcgcgtcttcaaagagaaggtggatacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1716 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcacaaaaaaactaatgaaaatcacggcagagtggctctggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1717 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagccttgggggccatatttaccgatgagaacaagtggaaatcggcgcgtgaggctgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1718 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagtaggttttgggagctggttgacaaggaaagaaacctccatcttgaagggaaatgtgaaacatgtgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1719 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggcagcagagccatatggtacatgtggctcggagcacgcttcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1720 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaatgaagaccattggttctccagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1721 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggaggagcaatgtatgccgatgacaccgcaggctgggacacaagaatcacaatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1722 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaaacttgccgaggccatttttaaattgacgtatcaaaacaaggtggtgcgtgtgcaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1723 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccaaagaccaacaccaagaggcacagtaatggacatcatatcgagaagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1724 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaaggaatcttcaaaagcatccagcacttgacagcctcagaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1725 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatcgctgtgcaagattggctagcaagagtagggcgtgaaaggttgtcaagaatggccatcagtggagatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1726 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaacagctctaaatgacatgggaaaggttaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1727 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtcgcacactcgtagttccatgcagaaaccaagatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1728 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatttcccagggagctgggtggtctttacgggagacggcctgtttggggaagtcttacgcccaaatgtggagcttgatgtacttccacagacgtgatctcaggctagcggcaaatgccatctgctcggcagtcccgtcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1729 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacaacctggtccatacacgccagccatgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1730 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacgacgtggagcatccacgcgtcccacgaatggatgacgacggaagacatgttgacagtttggaacaaagtgtggatcctagaaaatccatggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1731 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacgacgtggagcatccacgcgtcccacgaatggatgactacagaagatatgttaacagtatggaacaaagtatggattttagaaaacccttggatggaagacaaaactccagtggaatcatgggaggaaatcccatacctgggaaaaagagaagaccaatggtgcggctcactgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1732 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacgacgtggagcatccacgcgtcccacgaatggatgactacagaagatatgttaacagtatggaacaaagtatggattttagaaaacccttggatggaagacaagacacctgtagagagctgggaagaaataccatatttaggaaaaagggaagatcaatggtgcggaagcctgattgggctgacaagcagagccacctgggcgaagaatatccagacagcaataaaccaagtcagatccctcattggcaatgaggaatacacagattacatgccatccatgaaaagattcagaagagaagaggaagaggcaggagttttgtgg

SEQ ID NO: 1733 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacgacgtggagcatccacgcgtcccacgaatggatgactacagaagatatgttaacagtatggaacaaagtatggattttagaaaacccttggatggaagacaagacacctgtagagagctgggaagaaataccatatttaggaaaaagggaagatcaatggtgcggaagcctgattgggctcacgtcgagggcgacgtgggccaagaacattcagacggccataaaccaagtcagatccctcattggcaatgaggaatacacagattacatgccatccatgaaaagattcagaagagaagaggaagaggcaggagttttgtgg

SEQ ID NO: 1734 - DNA, 2700 bp, Artificial sequence
  engineered viruses
ggaactggcaacataggagaaacgctaggagagaaatggaaaagcaggctgaacgcattggggaaaagtgaattccagatctataaaaaaagtggaattcaagaagtggacagaaccttagcaaaagaaggcattaaaagaggagaaacggatcatcacgctgtgtcgcgaggctcagcaaaactgagatggttcgttgaacgcaacttggtcacaccagaagggaaagtagtggatttaggatgtgggaggggggggtggtcctattactgcggcggactcaagaatgtccgcgaagtgaagggccttaccaaggggggccctggtcacgaagaacctatccctatgtcaacatatgggtggaatctagtacgcttacagagcggagttgacgttttctttgtgcctcctgaaaaatgcgatactctactctgtgatataggggaatcatcaccaaatccgaccgttgaggcggggaggacactccgcgtcctcaacctggtcgagaattggctgaataataatactcagttttgcgtaaaggttcttaacccgtacatgccttccgttattgagcgtatggaaacgctccagcggaagtacggaggcgctctagttcgaaatcccctctccagaaattccactcacgaaatgtattgggtaagtaacgcatcaggtaatatagtctcatctgtgaacatgatttcaagaatgctgattaacagattcaccatgcgccataaaaaggcgacatatgagccagatgtcgacctcggaagcggaacccgcaatattggaattgaaagtgagacaccgaacctagatatcatcggtaagcgtatcgagaagatcaagcaggagcatgaaacgtcctggcattacgatcaagatcatccatacaaaacctgggcatatcacggaagctatgaaacaaagcagacgggcagcgccagttcaatggtgaacggcgttgtccgtctgcttaccaaaccctgggacgtcgtgcccatggtcacccagatggccatgacggacacgacgccctttgggcaacagagggtgttcaaagagaaggtggacacgagaacccaagaaccaaaagaaggcaccaaaaagctaatgaagatcacagccgaatggctgtggaaagaactaggaaagaaaaagacacctagaatgtgcaccagagaagaattcacaaaaaaggtgagaagcaatgcagcactaggggcaatatttacggacgaaaataaatggaaatcagcaagagaagccgttgaagatagcaggttttgggagcttgtcgacaaggagcggaacctgcaccttgaaggcaagtgcgagacctgcgtatacaacatgatgggaaaaagagagaaaaaactaggagagtttggtaaagcaaaaggaagtagggcaatttggtacatgtggttaggggcgagattcttagagttcgaagccctaggatttttgaacgaggaccattggttctcgagagagaactccctgagtggagtagaaggagaagggctgcataagctaggttacatcttaagagaggtgagcaagaaagaaggtggtgcgatgtatgccgacgataccgctggttgggatactcgcatcaccatagaggatttaaaaaatgaagaaatgataacgaaccacatggcaggagaacacaagaagctcgcggaggcgatcttcaagctcacgtaccagaataaggtggtgcgtgtccagcgtcccacgcctcgtgggacggtgatggatataatatccaggagagaccaaaggggtagtggacaagttggtacctatggcctcaacactttcaccaacatggaagcacaactaattaggcaaatggagggggaggggatcttcaagtcgatccagcacctcaccgcctcggaagaaatagccgttcaggactggctcgctagagtcggtcgtgagcggctgtcccggatggcaatatccggggatgattgtgttgtgaaacctttagatgatagatttgcaagagctctaaccgccttgaacgacatgggcaaggtgaggaaggacatacagcaatgggagccctcaagaggatggaacgactggacacaggtacccttctgttcacaccattttcacgagttaattatgaaagatggtagaacactggttgtgccttgccgcaaccaggatgaattgatcggcagagcccgaatatctcaaggtgctggttggtctcttcgtgaaactgcttgtctcggtaaatcctatgctcaaatgtggtccttaatgtacttccatcgtcgtgatcttcgtcttgctgctaatgccatttgttctgctgtcccctcacactgggttccaacaagccggacgacgtggagcatccacgcgtcccacgaatggatgactacagaagatatgttaacagtatggaacaaagtatggattttagaaaacccttggatggaagacaagacacctgtagagagctgggaagaaataccatatttaggaaaaagggaagatcaatggtgcggaagcctgattgggctcacgtcgagggcgacgtgggccaagaacattcagacggccataaaccaagtcagatccctcattggcaatgaggaatacaccgactacatgcctagcatgaagcgcttccgccgggaagaggaggaagcgggtgtattgtgg
